United States Patent 10,233,495 (METHODS AND COMPOSITIONS FOR SCREENING AND TREATING DEVELOPMENTAL DISORDERS) - sequence listing, part 33

SEQ ID NO: 309 - DNA, 2534254 bp, Homo sapiens (residues 1,267,128-2,534,254 of 2,534,254)
  misc_feature (113081)..(163080): n is a, c, g, or t
  misc_feature (349820)..(399819): n is a, c, g, or t
  misc_feature (574875)..(624874): n is a, c, g, or t
  misc_feature (826584)..(876583): n is a, c, g, or t
  misc_feature (1003061)..(1053060): n is a, c, g, or t
  misc_feature (1247676)..(1297675): n is a, c, g, or t
  misc_feature (1376374)..(1426373): n is a, c, g, or t
  misc_feature (1553637)..(1603636): n is a, c, g, or t
  misc_feature (1774306)..(1824305): n is a, c, g, or t
  misc_feature (1862617)..(1962616): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcctcccaccctcattcacttctgtcaggctagactctctctccttttcattggcttgtcttagctattaataagtctcagctgggcgcagtgggtcacacctgtaatccgagcactttgggaggccaaggcgggtggatcatgaggtcaggagattgagaccatcctggctaacacggtgaaaccccgtctttactaaaaatacaaaaaaaaaaaaaaaaaaagctgggcgcggtggtgggcgcctgtagttccagctactcaggaggctgaggcaggagaatggcatgaacccaggaaccggagcttgcagtgagccgagattgtgccactgcactccagcctgggagacagagcgagactccatctcaaaaaaaaaagtaagtctgtgaccaggggcactggctcacatcttaatcccagcactttgggaggctgaggtaggtggaatacctgaggtcaggagttcgaaaccagcctgtccaagatggcgaaaccccatctctactaaaaatacaaaaattagctggcatgttacttggcgcttgtaatcccagatgcttggcaggctgagggatgagaatcgcttgagcccgggaggcagaggtggcagtgagctgagattgtgcctctgcactgcagcctgcatgacagagtgagactccatctcaaacaaaaaacaaaaaaccaaaaaagaaaaaaattaaaaaagcaaaatgaaatcttttgtgctacacagaaacattggctactcatggggtaaaaatctcagggccaagccttgctttatagaaacgtataagcaagaaaagtgtagaagtgtttatgtcttggtttcaaggtgactgcatagctaagacaagttgacttaaaggagatcaagactggagatgacaagagtgaaaccagggaaacatcatcttcaaataagtacacaaggctgccagtgacatccctcagtcctgattaagcctatttgatttcaccagttttaacccatcatgtgtttgcctttcttctccccagtccctggccccacctcttctgccacaaacgtcagcatggtggtatcagccggccctttgtccagcgagaaggcagagatgaacattctagaaatcaatgagaaattgcacccccagctggcagagaagaaacagcagttcagaaacctcaaagagagatgttttgtaactcaactggccggcttcctggccaaccagcagaagaaatacagtaagatctataggctcaccatcatgaaagtgatgaatgatgtcctgtcttctgagacactaaatgctctctccatcaaaaataatgtcatcctccccatacttctaggaaaacagaaatgggtattttaacattttgtcaaagttggaagacagacgtaccaaagtatttagcaactttccatgtttgcaatcagatgggggtgggactagagttaaactgccatttattgatttctgacacaggcacagaatgatctgttttctccaagaggctcaatcgtgttttcaagaatcctctctaccatataagatcctgcagacaaataacatctagtctgttgttctaaatgtctgagactagtgaacttttattcagttcaagtttctgttgaggcccaacaggcaaagctctgttctagtgactctgagggaaacttggtgatagtagccagtacctgctctgaggggcttcaagaggagtctactcctaatagaacctgtgctgtctataagtgacagcatcaagagcagggagtaggggccgtgcatggtggctcactcctgtaatcccagcactttgggaggctgaggcgggcagatcatgaggtcaggagtttgggaccagcctgggcaacatggagaaaccccatctccactaaaaatacaaaaagtagatgggcgtggtggcaggtgactgtaatcacccctgctcaggaggctgaggcaggagaatcctttgaacccaggaggctgaggttgcagtgagccaagattttgccattgcactccagcctgggcgacagggcaagactggtaaaaataataataataataatgataaataagaataaaaagcagagagtagcttggtgagagtgaagtcctgcttcctggggcacagagtcttgttgctaaagaggaagaaagatcgcacccgagaatgtgtggagataacagtgcagtgtacagagcagggacagtgggcctgtctcctgggctccatccaagttgcttgtcttgtctgtccctcagtttcctcacctgttcagagggtactacaataatacctacctctgtaaattgctgcagtgaattacatgagctatttcttgtcaatctcctagaacatttattggcacacagtgaacactatttattagttcttcattctgctgtttctaaattaacacaaactttattaacatttgggcatatttccttcatggccttaaggtgttatgtgtcacactttatgcttcagatatgattcttaaaatcataactgaagatatgatttaaaaatcaaagattttaaaaatctttcacatacttgtccttgaaattcccagtaaaagggaaaccatcagtcccatagtcctaggggccttcccgactgtacaagaaatcactacttcatgccccagtgcagtgttttagaggagaggctgcaaggcttgggaaagtggccccgcattcagagtcagacctcacggactgtgaattctgactccacttcgttgtggttgaatcatcttgtcaacttccttgatgtgcccttgaggttctctttcttcatctctaaattttggaggatcagatgccagaaagtcaggagactgaagagtaaagatgtggaaatccctgtctagaccctggtactggggagagttttgtccttgggatggacctggctcctgccctgtaggcaatgaccacagcagcatgtccagccttccactgaggcaggcgtgtctgtcttttctcagaatatgaagagtgcaaagacctcataaaatctatgctgaggaatgagcgacagttcaaggaggagaagcttgcagagcagctcaagcaagctgaggagctcaggtgaggggaccccatggtggcaggcaggggggcaggtgtgtaaatctctgaaatacagcagctcggtggggagacgtaagagctaagctgggccaggggaagggcaggaattgccatggcaggctcgctacacataaatatttatcaaacagagaagaaggataataaaaatgtatgggttgcagttgtttctcagagccttgttttctctttttcaaacaagtaattgttgatgtgaaatttacataacacaaaattaaccaaaggagtgtgaaccacacagcagcattcagtatactcaaaatggtgtgccatcaccaccccacttacccttagtgacaatcacctcctgactgactgcggcttctcattctttcactcaatcaatgttgccttctcgaccctgtcattcttttcttctttcgtcttttcaattcgccccatctgcacctggcctcatttctgtacatagctttgtatctagtggccgcaagatgcactatgtgtattttcacatggaaatgtccatggccagagtgaggaactgaaaggatgtctttttgaaacggaattaggaagacacctacttttgtttacagaagggaaagatgaatggaacatcatcgaggatcttgcaagagccctctctgatacagaggaagcctgtaaaccattttctattctttctcttggccacagacattcctttaaacatgtgctgaccttctgcttcgaggtctccttgaggacattatctcagaaatctctgttgcaatatttgagcggatcactgaacctttccactcttaaattttctctaccgtctcaccttaggcaatataaagtcctggttcacgctcaggaacgagagctgacccagttaagggagaagttgcgggaagggagagatgcctcccgctcattgaatgagcatctccaggccctccttactccggatgagccggacaagtcccaggggcaggacctccaagaacagctggctgaggggtgtagactggcacagcaccttgtccaaaagctcagcccaggtaaggtggccataggccctgatgacccaaaatcccaggcttatgagagactccagacctccatactttcacaatgacagttgtatcaatggtgtttttttccactaagcttatgtggccatgacatgaccaggacttcttgggtaagaacggagatgggaaacccatggggttggaggtcacagtattgcaagtgtccctcctcccttgatggaaggtggtctttggagcaagaggcagcatctgtctagttttaaaggacaggaaggaggctgcgatgggagcaggcttgttagagtgaaagagctctgcactaagaatgaaggttcccaggctgtcttttcggcaatgttcttagtaactgtcagagagtgaatgacttgtccttcctgagtttctctctctccgtggcagacaaattgtctcttgcaagggtctgaagcattcaaatgtgggaacacttacaactgctttccaaaatgagatgaaggccctcgccgtgtgatgttggagaaggcactttatgtgggggcgttttgtggtaggaagtgcttcagactggagcactccccatggatagaatgtccctgaagaacacagcagaagccacttggaggcttgaaatcttctgatgcatagaggactgtgggacaagtttgtctgcttctaagagaaagaatgaggtttgaaatgcaaaccgtgacaggacaccaagcctgtgcctgggaatcagatctggcaggatgggggagacagctgccaacgtccagagagaggctgcacaagcctccagtgatatgggaagcaaaaggtcttttcaatatttggccacatcttgatggtggccctccagatcagaaatgcattgcctgatggatcaggaaaccatgccagggcattctgttaaagataaaacatgagagttttcagttgaacggtgacccatgcctagatgttcatgtctctgttgcacattgggctgactgtgcttgcagactgtgaagtgggaaatatctgaacgaacacttctgtatttacagaaaatgacaacgatgacgatgaagatgttcaagttgagttggctgagaaagtgcagaaatcgtctgcccccaggtaacactgaatactcaggaacaattaatggatggtaacatatgaggaatatctaggaggcacaccctctctggcatctatgatcggccaaaaacccacatttgcttggccacagtatgtgaaatataacccagcttagacacagggtgcggcagctgtcatgtttctctgtgtgtgccgagtgtcacgtctgcaccgtacagggatagctgagtcttcatcctcctcagctcctatctgtccagtgcaatgaacagcagctgctctcttcctctctggttcccatggcagccatgctctgttgcagagagaacaggattgcatgttcccccttaatgggaacctccattttgctttctgggaccactctcttaatgccgcctgtcaaaaccagctaggactccctggggtccaatccctctgtgtttaatcttctgtcatctctgtcccacctggctcatcagggagatgcagaaggctgaagaaaaggaagtccctgaggactcacaggaggaatgtgccatcacttattcaaatagccatggcccttatgactccaaccagccacataggaaaaccaaaatcacatttgaggaagacaaagtcgactcaactctgattggctcatcctctcatgttgaatgggaggatgctgtacacattattccaggtagcctctgttttccttgtgtctcatacctctctctaggctgaggaagataaactctgaagacaggctctataaacacaaattcatttgaataaaaaactgtgatgggtttctaaacagatatcagggactttttttgtccttctcagctaatgtcatgactttgtctgccagtccccagtatcaagttactcaaccccaggcaagtgtgacaatctcatagtcacctgagtgcaggaggtgcacaggcagtatctgtcaggcctactagcttcgattcagtatctcttgtcatctgtgattaagtcctctgtccctgaacaatgtccatggaatttctatgcctgtttaaggaagctggcagccttgcctttgtatttggaaatattgttcccccggcttcactgctctcagctttcatctggatctcctttaagtcagcttgcttagctgcacagtcaccctgaaatcaggacagaaacttttcttctttactttgctgatatatttccataaagcaaggctggaccctggttctccaccctgtcaatgcaatggctgatccaatgtttctttgtagcatcgtggatttttttttttttttttttttttgtgatggagtcttgctctgtcacccaggctggagtgcagtggcaccatcttggcttggtgcaacctctgcctcccagattcaagtgattctcctgcctcagcctcctgagttgctgggaccacaggtgcacaacatcacatctggctaatttttgtatttttagtagagacagggtttccccatattggccagggtagtcctgaactcatgacctcaaatgattcacctgtcttggcctcccaaatcacagattctttttaaagcaagagttgttcaaatttatctatcagtcgtgtttcatgtatagatgcctctaaacatttaatgtccatgttacctggtgatataagtccgtatcgcagcagcactcttagaaaattgtttgaccaatttttggagatttttttggggaaaaaattttgtttaactttgactcaggcagggaatatggcattatggtctacacgtagagggagattttggcctgtgggtctggaaagcagggttatctaattctcaccaaagttaatctaggacaccctagaatattcctgtcagaatccttattcttgcactgagaatagttatgtccttgtgctatgactggacagtgatttgttcatatgtgaagtatgaattgcttaatgtgacctgcttctctgaatttatttacagaaaatgaaagtgatgatgaggaagaggaagaaaaagggccagtgtctcccaggtaatgttgtggaattgttggctgttaattcagtagtgacatctggagattgtagatttagggaaaatgaggaagtgatgaatagaactatttcttccattcacccagctacaaattgtgctgatttacaatgttgtatgttatttgtagcacttgtattggttttaatttcatagtcctctcaagataggaacttgccatcagatgagccaggtgaactagccaaacagggttttcttgttgatcttttcaaaaaaccagccctggattcattgatcttttgaagggttttttgtgtctctatctcctttagttctgctctgatcttagttacttcttgtcttctgctagcttttgaatttgtttgctttgcttctctagttattttaattgtgatgttagggtgtcaattttagatcttttctgctttctcttgtgggcatttagtgctataattttccctctacacattgctttaaatgtgtcccagagattctgatatgttgtgtctttgttctcattggtttcaaagaacatctttatttctgccttcattttgttattttcccagtagtcattcaggagcaggttgttgagtttccatgtagttgtgcggttttgagtgagtttcttaatcctgagttctaatttgattgcactgtggtctgacagtttgttgtgatttccattcttttacatttgctgacgagtgctttacctccaactatgtggtcaattttggaataagtgtgatgtggtgctgagaagaatgtatattctgtggatttggggtggagagttctgtagatgtcttttaggtctgcttggtggagagctgagttcaagtcctggatatccttgttaagcttctgtctcattgatctgtctaatattgacagtggggtgttaaagtctcccatgatgattgtgtggagtctaaatctctttgtaggtctctcaggacttgctttatgaatctgggtgctcctgtatacggtgcatatatgtttaggatagttaactcttgttgaattgatccctttaccattatgtagtggccttctttgtctcttttgatcttggttggtttaaagtctgttttatcagagactaggattgcaacccctgcctttttttgttttccatttgcttggtagatcttcctccatccctttagtttgagcctatgtgtgtctctgcatgtgagatgggtttcctgagtacagcacactgatgggacttgactctttatccaatttgccattctgtgttttttaactggggcatttagcccatttacatttaaggttaatattgttatgtgtgaatttgatcctgtcgttatgatattagctggttatttcgcccattagttgatgcagtttcttcctagcgtcaatggtctttacagtttggcatgtttttgtagtggctggtaccggttgttcctttccatgtttactgcttcctttaggagctcttgtaaggcaggcctggtggtgacaaaatctctcagcatttgcttctctgtaaaggatttatttctccttcacttatgaagctttgtttggctggatatgaaattctgggttgaaaattcttttctttaagaatgttgaagatgctggagaggatgtggagaaataggaacacttttacactgttggtgggactgtaaactagttcaacgattgtggaaggcagtgtgacaattcctcagggatctagaactagaaataccatttgacccagccatcccattactgggtgtgtacccaaatgattataaatcatgctgctgtaaagacacatgcacacatatgtttattgtggcactattcacaatagcaaagacttggaaccaagccaaatatccagcaatgatagactggattaagaaaatgtggcacatatacaccatggaatactatgcagctataaaaaatgatgagttcatgtcctttgtaggggcatggatgaagctggaaaccatcattctcagcaaactattgcaaggacaaaaaaccaaataccgcatgttcttactcacaggtgggaattgaacaatgagaacacatggacacagaaaggggaacatcacacactggggcctgttgtagggtggggggagggaggaggggtagcattaggagatatacctaatgttaaatgatgagttaatgggtgaagcacaccaatgtggacatgtatacatatgtaactaacctgcacgttgtgcacatgtaccctaagacttaaagtattatatatatctgtatatatatatatatatacatacacacaaaaaataataaaggaaaactatacatatggaaaaaaaaaagaatgttgaatattgctcccactctcttctggcttgtagggtttgtgccaagagatctgctgctagtctgatgggcttccctttgtgggtaatccgacctttctctctggctgcccttagcattttttccttcatttcaaccttggtgaatctgacaattaagtgttttggggttgctcttctcgaggagtatctttatggtgttctctgtgtttcctgaatttgaatgttggccttccttgctaggttggggaagtcctcctggataatatcctgaagaatgtttcccagcttggttccattctccccgtcactttcagtacaccaatcaaatgtagatttggtctttccacatagtcccatatttattggaggcttgttcatttctttttactcttttttctctaaacttctcttctcgcttcatttcactaatttgatcttgaatcactgataccatttcttgcacttgatcgaattggctactgaagcttgtgcatgcatcacgtagttctcgtgccatggttttcagctccatcaggtcatttaaggtcttctctacactgttcattctggttagccattcgtctaatcttttttcaaggtttttagcttccttgcgatgagttcgcacatcctcctttagctcagagaagtttgttattaccgactttctgaagcctacttctgtcagctcatcaaagtcattctccatcctgctttgttccattgctggcgaggagctgcgatcctttggaggagaagggatgtcaggtttttggaattttcagcttttgtgctctggtttctccccacctttgtggttttatctacccttggtctttgatgatggtgacctacagatggggttttggggtggatgtcttttttgttgatgttgatgttattcctttctgtgtgttagttttccttctaacagtcaggtccctcagcttcaggtctgttggagtttgctggaagtccactccagaccctcaaacagggatttcttggtgttgcctattctctccgatgtgtttaaatccagggagaggtgtatacatgcttttttcctatttgttggtagtatgttggctagtatttttgcaagaaaagaaattgaaaaagtaaatatattatatcaaaatattgggaaaatggggcccttaatacacaagatctgtgtctgcactgcgtcaagaactctcttcacttgaatgctgcatgtaaaattcaacccaatttatgcaaagtagttgaagccctgtgtcagttctctgtgctgcaagtcatgatggtagtttacagggagagtctgggtgccctgagttggctcatctgtggcaaatgtactgagcacatgctgcccatttttgctctgtccccagagcagtcaccctccaccctgcatttagaaggatagttttatttctcttgaaggaaaaatgcctttggtttctgtgaccactccattctgtctcccatcagatcatctgggaggttttgttgtctaatgtctgttggttaaatcttctatcatccctgtcctgcctggctcatcaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagtgagtactacactgtgaaggtgataaagctccagttcatggcccaggtagaccccataatctttgggccttgtgccccttgttgggctgagatttgccatcaccgtgggctgaacctatatatcaatgtagatttcaatcactctggagtcgagtctgaagcacaggcatggggtgggtcagtgagctttgctctcttcctagtctcaggccatgcccgtgccaacctggactgattgtcacgacattgaactcaaggcaggtgtggcaaactcacaccaaactatgcagcacatgcccaggagttgtctgtcagctcagctcatctgaattaaatgtctcttgccagctacaaaattccttatgagttttgttcccaaagcatgtctgtgtggttctttacccgcccaaggccagtgtcacccttgtctacctctcagtgaaagatgtgacccaggtttcactgaatttattcccattttctgtgtcttctaagttcgcttgttttagctcatctgtccatcatgttcctggtatgttttctagataaatggctgacttttcacccacaaaagccataatagctgatgcttctgtgtagaaccaagtttcattttgactcaagagctggtacattgcaccccttcatcaaatctctgtgtccacaatctcataaactatcaaattctgggtatttgatgagagaaagcttaatattgaagtgtctctcctatgaggtgttagaactatttgcctacaatttattggggaaaaaatttctcatttgtgtacagaagcctaggacagagcacatagggaagataacattccaacacaggggaattttgcccaaggctcatgaaagaacccaagccagttttctcaagacttgacctcaggcctactggaatatttctctcaaagtctcctgttctcacactgacaagactgatgtccctgtgttaggattggacagaggaatgtttctgtgtgcaaggaagaactgcttaatgtaagagggcccatctgaatttatttgcaggacatcggtgggatcaagtgaaaaaggaggaccaagaggcaacaggtcccaggtgagtctgagaaattgtggagagttaatttgatgttgacacctggagatgccaagtccagggaaaacagtacatgctgaaaataatgattttgtcttgtcagacaagtctgaattatgcctactacattgctttctggttctcattagagtacatgtttaggtttccatttcttcctacccttatcatttactaacctagtgaaagttgaccataactcaaaagctgtattctcatggtaactgcagggaaacttgagcacattttatgcaaaattattgaggacatgcttttcatgatcactgttcacagtgtgtcctgagagcacaaatacagagtgtcctttgactccctcatcagtgtgtcacctgaccaattcactgagctcgctctgtgtgtgtgtgtgtgtgtgtgtgtgtgtgtgtgtgtttgtgtgtgtgtgtgagtgtgtgtctctctctttcatccttttctacctggccctagtctatcccaacataaaggcaataatttcttacctcattaatggatctgtcctttttcttttcaaactcttccttacgttagccatgaaatctagctggggctgtgtggtttctgattccccctggcttattctttactttttcccacttttccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtattggcttggctgttgacatggatggtgagtacctttctatgaaggtgataaggatccactgagtcttctggttagggtcatattcctactgcaagtggcccttactgagctgagagatgtcattgccacagggaggtcctataggcacatgtaggttgaatgaaactctagttccacttggaagcccagacaagggatgggtcagtgagcaaggctctcttcctagtctcaggccatgcctgtggtgccctaatcctactctcatgacgttcgacctgggcagatgtgacaaattcacacaactctgattttgtctcaattttgtagatcttgtagatttcatccttcactctaatttcagcgtctaaaatcctcgctaccatgaacaatctgagtatttgatgagacagggctgaatagtgcagtttttctcctagcaaccatttgggggcatttgctttaaatcgattggaaaaatatggcataaccatttgcacaaacttgggacaaatgatattgggataacgatctaccagaatagggaattttacccacagtttctgggacaaaaaccaaggaatctctatggtgatcagccttcaggcctcctgaagactatctctcacagtgtcctattctcatgctgaggagcctgaagtccctgtgtgaggattagacagtggattgttatgtgtgtaggagaaccagcttaatatgtctgtccatgtctgaacttattgcagaaattgaaaagtaccaagaagtggaagaagaccaagacccatcatgccccaggtaactttgagcaattatggatgcttaattctgtgttgacacctggagatgccaggtccagggaaaacaagagtgtgttcaatttcatgttttcaacgaaggttgaattactcctcctgacattgctgttggttttcattgcagtagatgtttaggtttccatttcttcctccccttatcatttactaacttactataggttgaccatacctcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaactcgctgagctcactttctcctctctctctctctctctccctctccctgtctttctctttcattcttttctacctggccctggtctatcccaacataaaggcaataattcattacctcattaatggatctgtcctttttctttttaaacagttccttatgttagccatgaaatctagctggggctgtgtggtttctgattccccctggcttattctttactttttcctacttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttaccgtgaaggtgataagcctccacctggtcttccagataggggtgatattcctgttccaagtggcccttactgacccgagagatgtcattgccgcaggcaggacctatgggcgcatataggttgtaatgaaactgtagtctcagttggaagcctagacatgaaatgggtcagtgagcaaggctctattcctagtctccagccatgcctgtggcaagctgagcccgctctcagcacattggacccaggcagatgtaaaaaattcacagaactatgatttggactgaagggtttgtagatttcttccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatggggatatttcacccttggttctgagatgcaaaccaaagaatatcatgaccagctttcaggcctcctgaagtatctctctcacattgtcctgttctcatgctgaggagcctgagatccctgtgtggggattagacagtggactgttatgggtgtaggtgaattggcttattttgtctgtccctgtctgaatgtattgcaggaactaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttccagcaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctgtgtgtgtgtgtgtctgtgtgtgtgtctgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccagacaagggatgggtcagtgagcaagactctcttcctagtctcaggccatacctgtggcgccctgatcctatcctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcataactgtttgcacaaacttgggacaaatgatattgggataacgatctactagaatagggacattttacccacagtttctgggagaaaaaccgaggaatttctatcatgaccagccttcaggcctcctgaaatatatctctcacggtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctctgttaacacctggaggcaacagattcagggaaaccagagtgtgtttgatgtcatgttttcaacgaaggctgaattactcctactgtcattgctgttggttttcattgcagtagatgtttaggtttccatttcttcctccccttatcatttactaacgtaccataggttgaccatacttcaaaagctgtactctcatggccactgcatcgaattttgagcatattttatggaaaactattgagctcactcttttcatgatcacagtttgctgtgtgtcatgagggcactaactcagagtgtccttttactcccttaccagtatgtcacctggccaattcactaggtcactttctctctgtctctgtctctgtctctctctctctgtctctgtctctctctctctctctgtctttctctttcattgttttctacctggccctgttctatcccaacataaaggcaataatttgttacctcattaatggatctgtcctttttcttttcaaactcttccttacgttagccatgaaatctagctggggctgtgtggtttctgattccccctggcttattctttactttttcccacttttccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatggtgagtacctttctatgaaggtgataaggatccactgagtcttctggttagggtcatattcctactgcaagtggcccttactgagctgagagatgtcattgccacagggaggtcctataggcacatgtaggttgaatgaaactctagttccacttggaagcccagacaagggatgggtcagtgagcaaggctctcttcctagtctcaggccatgcctgtggcgccctaatcctactctcatgacgttggacctgggcagatgtgacaaattcacacaactctgattttgtctcaattttgtagatcttgtagatttcatccttcactctaatttcagcgtctaaaatcctcgctaccgtgaacaatctgagtatttgatgagacagggctgaatagtgcagtttttctcctagcaaccatttgggggcatttgctttaaatcgattggaaaaatatggcataaccatttgcacaaacttgggacaaatgatattgggataacgatctaccagaatagggaattttacccacagtttctgggacaaaaaccaaggaatctctatggtgatcagccttcaggcctcctgaagactatctctcacagtgtcctattctcatgctgaggagcctgaagtccctgtgtgaggattagacagtggattgttatgtgtgtaggagaaccagcttaatatgtctgtccatgtctgaacttattgcagaaattgaaaagtaccaagaagtggaagaagaccaagacccatcatgccccaggtaactttgagcaattatggatgcttaattctgtgttgacacctggagatgccaggtccagggaaaacaagagtgtgttcaatttcatgttttcaacgaaggttgaattactcctcctgatattgctgttggttttcattgcagtagatgtttaggtttccatttcttcctccccttatcatttactaacttactataggttgaccatacctcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaactcgctgagcttactttctcctctctctctctctctctccctctccctgtctttctctttcattcttttctacctggccctggtctatcccaacataaaggcaataattcattacctcattaatggatctgtcctttttctttttaaacagttccttatgttagccatgaaatctagctggggctgtgtggtttctgattccccctggcttattctttactttttcctacttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcattgccgcaggcaggacctatgggcgcatataggttgtaatgaaactgtagtctcagttggaagcctagacatgaaatgggtcagtgagcaaggctctattcctagtctccagccatgcctgtggcaagctgagcccgctctcagcacattggacccaggcagatgtaaaaaattcacagaagtatgatttggactgaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatggggatatttcacccttggttctgagatgcaaaccaaagaatatcatgaccagctttcaggcctcctgaagtatctctctcacattgtcctgttctcatgctgaggagcctgagatccctgtgtggggattagacagtggactgttatgggtgtaggtgaattggcttattttgtctgtccctgtctgaatgtattgcaggaactaaaaaggaccaagaagaggaagaagaccaaggcccaccatgccccaggtaactgagcaattgtggacagctacttctgtgttgacatctggagactcctggttcagggaaaacagagcgggctgacattatcgattacatcttttccagcaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctgtgtgtgtgtgtgtctgtgtgtgtgtctgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccaggcaagggatgggtcagtgagcaagactctcttcctagtctcaggccatacctgtggcgccctgatcctatcctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcataactgtttgcacaaacttgggacaaatgatattgggataacgatctactagaatagggacattttacccacagtttctgggagaaaaaccgaggaatttctatcatgaccagccttcaggcctcctgaaatatatctctcacggtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctgtgttaacacctggaggcaacagattcagggaaaccagagtgtgtttgatgtcatgttttcaacgaaggctgaattactcctactgtcattgctgttggttttcattgcagtagatgtttaggtttccatttcttcctccccttatcatttactaacttactataggttgaccatacctcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaactcgctgagctcactttctcctctctctctctctctctccctccctctccctgtctttctctttcattcttttctacctggccctggtctatcccaacataaaggcaataattcattacctcattaatggatctgtcctttttctttttaaacagttccttatgttagccatgaaatctagctggggctgtgtggtttctgattccccctggcttattctttactttttcctacttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggatggtgagtacctttctatgaaggtgataaggatccactgagtcttctggttagggtcatattcctactgcaagtggcccttactgagctgagagatgtcattgccacagggaggtcctataggcacatgtaggttgaatgaaactctagttccacttggaagcccagacaagggatgggtcagtgagcaaggctctcttcctagtctcaggccatgcctgtggcgccctaatcctactctcatgacgttggacctgggcagatgtgacaaattcacacaactctgattttgtctcaattttgtagatcttgtagacttcatccttcactctaatttcagcgtctaaaatcctcgctaccgtgaacaatctgagtatttgatgagacagggctgaatagtgcagtttttctcctagcaaccatttgggggcatttgctttaaatcgattggaaaaatatggcataaccatttgcacaaacttgggacaaatgatattgggataacgatctaccagaatagggaattttacccacagtttctgggacaaaaaccaaggaatctctatggtgatcagccttcaggcctcctgaagactacctctcacagtgtcctattctcatgctgaggagcctgaagtccctgtgtgaggattagacagtggattgttatgtgtgtaggagaaccagcttaatatgtctgtccatgtctgaacttattgcagaaattgaaaagtaccaagaagtggaagaagaccaagacccatcatgccccaggtaactttgagcaattatggatgcttaattctgtgttgacacctggagatgccaggtccagggaaaacaagagtgtgttcaatttcatgttttcaacgaaggttgaattactcctcctgatattgctgttggttttcattgcagtagatgtttaggtttccatttcttcctccccttatcatttactaacttactataggttgaccatacctcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaactcgctgagctcactttctctctctctctctctctctctccctccctctccctgtctttctctttcattcttttctacctggccctggtctatcccaacataaaggcaataattcattacctcattaatggatctgtcctttttctttttaaacagttccttatgttagccatgaaatctagctggggctgtgtggtttctgattccccctggcttattctttactttttcctacttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcattgccgcaggcaggacctatgggcgcatataggttgtaatgaaactgtagtctcagttggaagcctagacatgaaatgggtcagtgagcaaggctctattcctagtctccagccatgcctgtggcaagctgagcccgctctcagcacattggacccaggcagatgtaaaaaattcacagaagtatgatttggactcaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatggggatatttcacccttggttctgagatgcaaaccaaagaatatcatgaccagctttcaggcctcctgaagtatctctctcacattgtcctgttctcatgctgaggagcctgagatccctgtgtggggattagacagtggactgttatgggtgtaggtgaattggcttattttgtctgtccctgtctgaatgtattgcaggaactaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttccagcaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctgtgtgtgtgtgtgtctgtgtgtgtgtctgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccaggcaagggatgggtcagtgagcaagactctcttcctagtctcaggccatacctgtggcgccctgatcctatcctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcataactgtttgcacaaacttgggacaaatgatattgggataacgatctactagaatagggacattttacccacagtttctgggagaaaaaccgaggaatttctatcatgaccagccttcaggcctcctgaaatatatctctcacggtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctgtgttaacacctggaggcaacagattcagggaaaccagagtgtgtttgatgtcatgttttcaacgaaggctgaattactcctactgtcattgctgttggttttcattgcagtagatgtttaggtttccatttcttcctccccttatcatttactaacttactataggttgaccatacctcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaactcgctgagcttactttctcctctctctctctctctctccctccctctccctgtctttctctttcattcttttctacctggccctggtctatcccaacataaaggcaataattcattacctcattaatggatctgtcctttttctttttaaacagttccttatgttagccatgaaatctagctggggctgtgtggtttctgattccccctggcttattctttactttttcctacttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcattgccgcaggcaggacctatgggcgcatataggttgtaatgaaactgtagtctcagttggaagcctagacatgaaatgggtcagtgagcaaggctctattcctagtctccagccatgcctgtggcaagctgagcccgctctcagcacattggacccaggcagatgtaaaaaattcacagaactatgatttggactgaagggtttgtagatttcttccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatggggatatttcacccttggttctgagatgcaaaccaaagaatatcatgaccagctttcaggcctcctgaagtatctctctcacattgtcctgttctcatgctgaggagcctgagatccctgtgtggggattagacagtggactgttatgggtgtaggtgaattggcttattttgtctgtccctgtctgaatgtattgcaggaactaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttccagcaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctgtgtgtgtgtgtgtctgtgtgtgtgtctgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccaggcaagggatgggtcagtgagcaagactctcttcctagtctcaggccatacctgtggcgccctgatcctatcctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcataactgtttgcacaaacttgggacaaatgatattgggataacgatctactagaatagggacattttacccacagtttctgggagaaaaaccgaggaatttctatcatgaccagccttcaggcctcctgaaatatatctctcacggtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctgtgttaacacctggaggcaacagattcagggaaaccagagtgtgtttgatgtcatgttttcaacgaaggctgaattactcctactgtcattgctgttggttttcattgcagtagatgtttaggtttccatttcttcctccccttatcatttactaacttactataggttgaccatacctcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaactcgctgagctcactttctcctctctctctctctctctccctccctctccctgtctttctctttcattcttttctacctggccctggtctatcccaacataaaggcaataattcattacctcattaatggatctgtcctttttctttttaaacagttccttatgttagccatgaaatctagctggggctgtgtggtttctgattccccctggcttattctttactttttcctacttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcattgccgcaggcaggacctatgggcgcatataggttgtaatgaaactgtagtctcagttggaagcctagacatgaaatgggtcagtgagcaaggctctattcctagtctccagccatgcctgtggcaagctgagcccgctctcagcacattggacccaggcagatgtaaaaaattcacagaagtatgatttggactgaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatggggatatttcacccttggttctgagatgcaaaccaaagaatatcatgaccagctttcaggcctcctgaagtatctctctcacattgtcctgttctcatgctgaggagcctgagatccctgtgtggggattagacagtggactgttatgggtgtaggtgaattggcttattttgtctgtccctgtctgaatgtattgcaggaactaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttccagcaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctctgtgtgtgtgtgtgtgtctgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccaggcaagggatgggtcagtgagcaagactctcttcctagtctcaggccatacctgtggcgccctgatcctatcctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcataactgtttgcacaaacttgggacaaatgatattgggataacgatctactagaatagggacattttacccacagtttctgggagaaaaaccgaggaatttctatcatgaccagccttcaggcctcctgaaatatatctctcacggtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctgtgttaacacctggaggcaacagattcagggaaaccagagtgtgtttgatgtcatgttttcaacgaaggctgaattactcctactgtcattgctgttggttttcattgcagtagatgtttaggtttccatttcttcctccccttatcatttactaacttactataggttgaccatacctcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaactcgctgagctcactttctcctctctctctctctctctccctccctctccctgtctttctctttcattcttttctacctggccctggtctatgccaacataaaggcaataattcattacctcattaatggatctgtcctttttctttttaaacagttccttatgttagccatgaaatctagctggggctgtgtggtttctgattccccctggcttattctttactttttcctacttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcgttgccgcaggcaggacctatgggcgcatataggttgtaatgaaactgtagtctcagttggaagcctagacatgaaatgggtcagtgagcaaggctctattcctagtctccagccatgcctgtggcaagctgagcccgctctcagcacattggacccaggcagatgtaaaaaattcacagaagtatgatttggactgaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatggggatatttcacccttggttctgagatgcaaaccaaagaatatcatgaccagctttcaggcctcctgaagtatctctctcacattgtcctgttctcatgctgaggagcctgagatccctgtgtggggattagacagtggactgttatgggtgtaggtgaattggcttattttgtctgtccctgtctgaatgtattgcaggaactaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttccagcaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctgtgtgtgtgtgtgtgtgtgtgtgtctgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccaggcaagggatgggtcagtgagcaagactctcttcctagtctcaggccatacctgtggcgccctgatcctatcctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcataactgtttgcacaaacttgggacaaatgatattgggataacgatctactagaatagggacattttacccacagtttctgggagaaaaaccgaggaatttctatcatgaccagccttcaggcctcctgaaatatatctctcacggtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctgtgttaacacctggaggcaacagattcagggaaaccagagtgtgtttgatgtcatgttttcaacgaaggctgaattactcctactgtcattgctgttggttttcattgcagtagatgtttaggtttccatttcttcctccccttatcatttcctaacgtaccataggttgaccatacttcaaaagctgtactctcatggccactgcatcgaattttgagcatattttatggaaaactattgagctcactcttttcatgatcacagtttgctgtgtgtcatgagggcactaactcagagtgtccttttactcccttaccagtatgtcacctggccaattcactaggtcactttctctctgtctctgtctctgtctctgtctctctctctctgtctctgtctctctctctctctctgtctttctctttcattgttttctacctggccctgttctatcccaacataaaggcaataatttgttacctcattaatggatctgtcctttttcttttcaaactcttccttacgttagccatgaaatctagctggggctgtgtggtttctgattccccctggcttattctttactttttcccacttttccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatggtgagtacctttctatgaaggtgataaggatccactgagtcttctggttagggtcatattcctactgcaagtggcccttactgagctgagagatgtcattgccacagggaggtcctataggcacatgtaggttgaatgaaactctagttccacttggaagcccagacaagggatgggtcagtgagcaaggctctcttcctagtctcaggccatgcctgtggcgccctaatcctactctcatgacgttggacctgggcagatgtgacaaattcacacaactctgattttgtctcaattttgtagatcttgtagacttcatccttcactctaatttcagcgtctaaaatcctcgctaccgtgaacaatctgagtatttgatgagacagggctgaatagtgcagtttttctcctagcaaccatttgggggcatttgctttaaatcgattggaaaaatatggcataaccatttgcacaaacttgggacaaatgatattgggataacgatctaccagaatagggaattttacccacagtttctgggacaaaaaccaaggaatctctatggtgatcagccttcaggcctcctgaagactacctctcacagtgtcctattctcatgctgaggagcctgaagtccctgtgtgaggattagacagtggattgttatgtgtgtaggagaaccagcttaatatgtctgtccatgtctgaacttattgcagaaattgaaaagtaccaagaagtggaagaagaccaagacccatcatgccccaggtaactttgagcaattatggatgcttaattctgtgttgacacctggagatgccaggtccagggaaaacaagagtgtgttcaatttcatgttttcaacgaaggttgaattactcctcctgatattgctgttggttttcattgcagtagatgtttaggtttccatttcttcctccccttatcatttactaacttactataggttgaccatacctcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaactcgctgagcttactttctcctctctctctctctctctctctctctccctccctctccctgtctttctctttcattcttttctacctggccctggtctatcccaacataaaggcaataattcattacctcattaatggatctgtcctttttctttttaaacagttccttatgttagccatgaaatctagctggggctgtgtggtttctgattccccctggcttattctttactttttcctacttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcattgccgcaggcaggacctatgggcgcatataggttgtaatgaaactgtagtctcagttggaagcctagacatgaaatgggtcagtgagcaaggctctattcctagtctccagccatgcctgtggcaagctgagcccgctctcagcacattggacccaggcagatgtaaaaaattcacagaactatgatttggactgaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatggggatatttcacccttggttctgagatgcaaaccaaagaatatcatgaccagctttcaggcctcctgaagtatctctctcacattgtcctgttctcatgctgaggagcctgagatccctgtgtggggattagacagtggactgttatgggtgtaggtgaattggcttattttgtctgtccctgtctgaatgtattgcaggaactaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttccagcaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctctgtgtgtgtgtgtgtgtctgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccagacaagggatgggtcagtgagcaagactctcttcctagtctcaggccatacctgtggcgccctgatcctattctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcgtaactgtttgcacaaacttgggacaaatgatattgggataacgatctactagaatagggacattttacccacagtttctgggagaaaaaccgaggaatttctatcatgaccagccttcaggcctcctgaaatatatctctcacagtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctgtgttaacacctggaggcaacagattcagggaaaccagagtgtgtttgatgtcatgttttcaacgaaggctgaattactcctactgccattgctgttggttttcattgcagtagatgtttaggtttccatttcttcctccccttatcatttcctaacgtaccataggttgaccatacttcaaaagctgtactctcatggccactgcatcgaattttgagcatattttatggaaaactattgagctcactcttttcatgatcacagtttgctgtgtgtcatgagggcactaactcagagtgtccttttactcccttaccagtatgtcacctggccaattcactaggtcactttctctctgtctctgtctctgtctctgtctctctctctctgtctctgtctctctctctctctctgtctttctctttcattgttttctacctggccctgttctatcccaacataaaggcaataatttgttacctcattaatggatctgtcctttttcttttcaaactcttccttacgttagccatgaaatctagctggggctgtgtggtttctgattccccctggcttattctttactttttcccacttttccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatggtgagtacctttctatgaaggtgataaggatccactgagtcttctggttagggtcatattcctactgcaagtggcccttactgagctgagagatgtcattgccacagggaggtcctataggcacatgtaggttgaatgaaactctagttccacttggaagcccagacaagggatgggtcagtgagcaaggctctcttcctagtctcaggccatgcctgtggcgccctaatcctactctcatgacgttggacctgggcagatgtgacaaattcacacaactctgattttgtctcaattttgtagatcttgtagatttcatccttcactctaatttcagcgtctaaaatcctcgctaccgtgaacaatctgagtatttgatgagacagggctgaatagtgcagtttttctcctagcaaccatttgggggcatttgctttaaatcgattggaaaaatatggcataaccatttgcacaaacttgggacaaatgatattgggataacgatctaccagaatagggaattttacccacagtttctgggacaaaaaccaaggaatctctatggtgatcagccttcaggcctcctgaagactacctctcacagtgtcctattctcatgctgaggagcctgaagtccctgtgtgaggattagacagtggattgttatgtgtgtaggagaaccagcttaatatgtctgtccatgtctgaacttattgcagaaattgaaaagtaccaagaagtggaagaagaccaagacccatcatgccccaggtaactttgagcaattatggatgcttaattctgtgttgacacctggagatgccaggtccagggaaaacaagagtgtgttcaatttcatgttttcaacgaaggttgaattactcctcctgacattgctgttggttttcattgcagtagatgtttaggtttccatttcttcctccccttatcatttactaacttactataggttgaccatacctcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaactcgctgagcttactttctcctctctctctctctctctctctccctccctctccctgtctttctctttcattcttttctacctggccctggtctatcccaacataaaggcaataattcattacctcattaatggatctgtcctttttctttttaaacagttccttatgttagccatgaaatctagctggggctgtgtggtttctgattccccctggcttattctttactttttcctacttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtatcttactgtgaaggtgataagcctccacctggtcttccagataggggtgatattcctgttccaagtggcccttactgacccgagagatgtcattgccgcaggcaggacctatgggcgcatataggttgtaatgaaactgtagtctcagttggaagcctagacatgaaatgggtcagtgagcaaggctctattcctagtctccagccatgcctgtggcaagctgagcccgctctcagcacattggacccaggcagacgtaaaaaattcacagaactatgatttggactcaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatggggatatttcacccttggttctgagatgcaaaccaaagaatatcatgaccagctttcaggcctcctgaagtatctctctcacattgtcctgttctcatgctgaggagcctgagatccctgtgtggggattagacagtggactgttatgggtgtaggtgaattggcttattttgtctgtccctgtctgaatgtattgcaggaactaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttccagcaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctctctgtgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccaggcaagggatgggtcagtgagcaagactctcttcctagtctcaggccatacctgtggcgccctgatcctatcctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcataactgtttgcacaaacttgggacaaatgatattgggataacgatctactagaatagggacattttacccacagtttctgggagaaaaaccgaggaatttctatcatgaccagccttcaggcctcctgaaatatatctctcacggtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctgtgttaacacctggaggcaacagattcagggaaaccagagtgtgtttgatgtcatgttttcaacgaaggctgaattactcctactgtcattgctgttggttttcattgcagtagatgtttaggtttccatttcttcctccccttatcatttcctaacgtaccataggttgaccatacttcaaaagctgtactctcatggccactgcatcgaattttgagcatattttatggaaaactattgagctcactcttttcatgatcacagtttgctgtgtgtcatgagggcactaactcagagtgtccttttactcccttaccagtatgtcacctggccaattcactaggtcactttctctctgtctctgtctctgtctctctctctgtctctgtctctctctctctctctgtctttctctttcattgttttctacctggccctgttctatcccaacataaaggcaataatttgttacctcattaatggatctgtcctttttcttttcaaactcttccttacgttagccatgaaatctagctggggctgtgtggtttctgattccccctggcttattctttactttttcccacttttccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatggtgagtacctttctatgaaggtgataaggatccactgagtcttctggttagggtcatattcctactgcaagtggcccttactgagctgagagatgtcattgccacagggaggtcctataggcacatgtaggttgaatgaaactctagttccacttggaagcccagacaagggatgggtcagtgagcaaggctctcttcctagtctcaggccatgcctgtggcgccctaatcctactctcatgacgttggacctgggcagatgtgacaaattcacacaactctgattttgtctcaattttgtagatcttgtagatttcatccttcactctaatttcagcgtctaaaatcctcgctaccgtgaacaatctgagtatttgatgagacagggctgaatagtgcagtttttctcctagcaaccatttgggggcatttgctttaaatcgattggaaaaatatggcataaccatttgcacaaacttgggacaaatgatattgggataacgatctaccagaatagggaattttacccacagtttctgggacaaaaaccaaggaatctctatggtgatcagccttcaggcctcctgaagactatctctcacagtgtcctattctcatgctgaggagcctgaagtccctgtgtgaggattagacagtggattgttatgtgtgtaggagaaccagcttaatatgtctgtccatgtctgaacttattgcagaaattgaaaagtaccaagaagtggaagaagaccaagacccatcatgccccaggtaactttgagcaattatggatgcttaattctgtgttgacacctggagatgccaggtccagggaaaacaagagtgtgttcaatttcatgttttcaacgaaggttgaattactcctcctgatattgctgttggttttcattgcagtagatgtttaggtttccatttcttcctccccttatcatttactaacttactataggttgaccatacctcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaactcgctgagcttactttctcctctctctctctctctctctctctccctccctctccctgtctttctctttcattcttttctacctggccctggtctatcccaacataaaggcaataattcattacctcattaatggatctgtcctttttctttttaaacagttccttatgttagccatgaaatctagctggggctgtgtggtttctgattccccctggcttattctttactttttcctacttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcattgccgcaggcaggacctatgggcgcatataggttgtaatgaaactgtagtctcagttggaagcctagacatgaaatgggtcagtgagcaaggctctattcctagtctccagccatgcctgtggcaagctgagcccgctctcagcacattggacccaggcagatgtaaaaaattcacagaagtatgatttggactgaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatggggatatttcacccttggttctgagatgcaaaccaaagaatatcatgaccagctttcaggcctcctgaagtatctctctcacattgtcctgttctcatgctgaggagcctgagatccctgtgtggggattagacagtggactgttatgggtgtaggtgaattggcttattttgtctgtccctgtctgaatgtattgcaggaactaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttccagcaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctgtgtgtgtgtgtgtgtctgtgtgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccaggcaagggatgggtcagtgagcaagactctcttcctagtctcaggccatacctgtggcgccctgatcctatcctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcataactgtttgcacaaacttgggacaaatgatattgggataacgatctactagaatagggacattttacccacagtttctgggagaaaaaccgaggaatttctatcatgaccagccttcaggcctcctgaaatatatctctcacggtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctgtgttaacacctggaggcaacagattcagggaaaccagagtgtgtttgatgtcatgttttcaacgaaggctgaattactcctactgtcattgctgttggttttcattgcagtagatgtttaggtttccatttcttcctccccttatcatttactaacgtaccataggttgaccatacttcaaaagctgtactctcatggccactgcatcgaattttgagcatattttatggaaaactattgagctcactcttttcatgatcacagtttgctgtgtgtcatgagggcactaactcagagtgtccttttactcccttaccagtatgtcacctggccaattcactaggtcactttctctctgtctctgtctctgtctctgtctctctctctctgtctctgtctctctctctctctctgtctttctctttcattgttttctacctggccctgttctatcccaacataaaggcaataatttgttacctcattaatggatctgtcctttttcttttcaaactcttccttacgttagccatgaaatctagctggggctgtgtggtttctgattccccctggcttattctttactttttcccacttttccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatggtgagtacctttctatgaaggtgataaggatccactgagtcttctggttagggtcatattcctactgcaagtggcccttactgagctgagagatgtcattgccacagggaggtcctataggcacatgtaggttgaatgaaactctagttccacttggaagcccagacaagggatgggtcagtgagcaaggctctcttcctagtctcaggccatgcctgtggcgccctaatcctactctcatgacgttggacctgggcagatgtgacaaattcacacaactctgattttgtctgaattttgtagatcttgtagatttcatccttcactctaatttcagcatctaaaatcctcgctaccgtgaacagtctgagtatttgatgagacagggctgaatagtgcagtttttctcctagcaaccatttgggggcatttgctttaaatcgattggaaaaatatggcataaccatttgcacaaacttgggacaaatgatattgggataacgatctaccagaatagggaattttacccacagtttctgggacaaaaaccaaggaatctctatcgtgatcagccttcaggcctcctgaagactacctctcacagtgtcctattctcatgctgaggagcctgaagtccctgtgtgaggattagacagtggattgttatgtgtgtaggagaaccagcttaatatgtctgtccatgtctgaacttattgcagaaattgaaaagtaccaagaagtggaagaagaccaagacccatcatgccccaggtaactttgagcaattatggatgcttaattctgtgttgacacctggagatgccaggtccagggaaaacaagagtgtgttcaatttcatgttttcaacgaaggttgaattactcctcctgacattgctgttggttttcattgcagtagatgtttaggtttccatttcttcctccccttatcatttactaacttactataggttgaccatacctcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaactcgctgagctcactttctcctctctctctctctctctccctctccctgtctttctctttcattcttttctacctggccctggtctatcccaacataaaggcaataattcattacctcattaatggatctgtcctttttctttttaaacagttccttatgttagccatgaaatctagctggggctgtgtggtttctgattccccctggcttattctttactttttcctacttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcattgccgcaggcaggacctatgggcgcatataggttgtaatgaaactgtagtctcagttggaagcctagacatgaaatgggtcagtgagcaaggctctattcctagtctccagccatgcctgtggcaagctgagcccgctctcagcacattggacccaggcagatgtaaaaaattcacagaagtatgatttggactgaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatggggatatttcacccttggttctgagatgcaaaccaaagaatatcatgaccagctttcaggcctcctgaagtatctctctcacattgtcctgttctcatgctgaggagcctgagatccctgtgtggggattagacagtggactgttatgggtgtaggtgaattggcttattttgtctgtccctgtctgaatgtattgcaggaactaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttccagcaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctgtgtgtgtgtgtgtctgtgtgtgtgtctgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccaggcaagggatgggtcagtgagcaagactctcttcctagtctcaggccatacctgtggcgccctgatcctatcctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcataactgtttgcacaaacttgggacaaatgatattgggataacgatctactagaatagggacattttacccacagtttctgggagaaaaaccgaggaatttctatcatgaccagccttcaggcctcctgaaatatatctctcacggtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctgtgttaacacctggaggcaacagattcagggaaaccagagtgtgtttgatgtcatgttttcaacgaaggctgaattactcctactgtcattgctgttggttttcattgcagtagatgtttaggtttccatttcttcctccccttatcatttactaacttactataggttgaccatacctcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaactcgctgagctcactttctcctctctctctctctctctccctccctctccctgtctttctctttcattcttttctacctggccctggtctatcccaacataaaggcaataattcattacctcattaatggatctgtcctttttctttttaaacagttccttatgttagccatgaaatctagctggggctgtgtggtttctgattccccctggcttattctttactttttcctacttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcattgccgcaggcaggacctatgggcgcatataggttgtaatgaaactgtagtctcagttggaagcctagacatgaaatgggtcagtgagcaaggctctattcctagtctccagccatgcctgtggcaagctgagcccgctctcagcacattggacccaggcagatgtaaaaaattcacagaactatgatttggactgaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatggggatatttcacccttggttctgagatgcaaaccaaagaatatcatgaccagctttcaggcctcctgaagtatctctctcacattgtcctgttctcatgctgaggagcctgagatccctgtgtggggattagacagtggactgttatgggtgtaggtgaattggcttattttgtctgtccctgtctgaatgtattgcaggaactaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttccagcaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctgtgtgtgtgtgtgtctgtgtgtgtgtctgtgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccaggcaagggatgggtcagtgagcaagactctcttcctagtctcaggccatacctgtggcgccctgatcctatcctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcataactgtttgcacaaacttgggacaaatgatattgggataacgatctactagaatagggacattttacccacagtttctgggagaaaaaccgaggaatttctatcatgaccagccttcaggcctcctgaaatatatctctcacggtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctctgttaacacctggaggcaacagattcagggaaaccagagtgtgtttgatgtcatgttttcaacgaaggctgaattactcctactgtcattgctgttggttttcattgcagtagatgtttaggtttccatttcttcctccccttatcatttactaacgtaccataggttgaccatacttcaaaagctgtactctcatggccactgcatcgaattttgagcatattttatggaaaactattgagctcactcttttcatgatcacagtttgctgtgtgtcatgagggcactaactcagagtgtccttttactcccttaccagtatgtcacctggccaattcactaggtcactttctctctgtctctgtctctgtctctctctctctgtctctgtctctctctctctctctgtctttctctttcattgttttctacctggccctgttctatcccaacataaaggcaataatttgttacctcattaatggatctgtcctttttcttttcaaactcttccttacgttagccatgaaatctagctggggctgtgtggtttctgattccccctggcttattctttactttttcccacttttccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatggtgagtacctttctatgaaggtgataaggatccactgagtcttctggttagggtcatattcctactgcaagtggcccttactgagctgagagatgtcattgccacagggaggtcctataggcacatgtaggttgaatgaaactctagttccacttggaagcccagacaagggatgggtcagtgagcaaggctctcttcctagtctcaggccatgcctgtggcgccctaatcctactctcatgacgttggacctgggcagatgtgacaaattcacacaactctgattttgtctcaattttgtagatcttgtagatttcatccttcactctaatttcagcgtctaaaatcctcgctaccgtgaacaatctgagtatttgatgagacagggctgaatagtgcagtttttctcctagcaaccatttgggggcatttgctttaaatcgattggaaaaatatggcataaccatttgcacaaacttgggacaaatgatattgggataacgatctaccagaatagggaattttacccacagtttctgggacaaaaaccaaggaatctctatcgtgatcagccttcaggcctcctgaagactacctctcacagtgtcctattctcatgctgaggagcctgaagtccctgtgtgaggattagacagtggattgttatgtgtgtaggagaaccagcttaatatgtctgtccatgtctgaacttattgcagaaattgaaaagtaccaagaagtggaagaagaccaagacccatcatgccccaggtaactttgagcaattatggatgcttaattctgtgttgacacctggagatgccaggtccagggaaaacaagagtgtgttcaatttcatgttttcaacgaaggttgaattactcctcctgacattgctgttggttttcattgcagtagatgtttaggtttccatttcttcctccccttatcatttactaacttactataggttgaccatacctcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaactcgctgagcttactttctcctctctctctctctctctctctccctccctctccctgtctttctctttcattcttttctacctggccctggtctatcccaacataaaggcaataattcattacctcattaatggatctgtcctttttctttttaaacagttccttatgttagccatgaaatctagctggggctgtgtggtttctgattccccctggcttattctttactttttcctacttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcattgccacaggcaggacctatgggcgcatataggttgtaatgaaactgtagtctcagttggaagcctagacatgaaatgggtcagtgagcaaggctctattcctagtctccagccatgcctgtggcaagctgagcccgctctcagcacattggacccaggcagatgtaaaaaattcacagaagtatgatttggactgaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatggggatatttcacccttggttctgagatgcaaaccaaagaatatcatgaccagctttcaggcctcctgaagtatctctctcacattgtcctgttctcatgctgaggagcctgagatccctgtgtggggattagacagtggactgttatgggtgtaggtgaattggcttattttgtctgtccctgtctgaatgtattgcaggaactaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttccagcaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctctgtgtgtgtgtgtgtgtctgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccaggcaagggatgggtcagtgagcaagactctcttcctagtctcaggccatacctgtggcgccctgatcctatcctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcataactgtttgcacaaacttgggacaaatgatattgggataacgatctactagaatagggacattttacccacagtttctgggagaaaaaccgaggaatttctatcatgaccagccttcaggcctcctgaaatatatctctcacggtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctgtgttaacacctggaggcaacagattcagggaaaccagagtgtgtttgatgtcatgttttcaacgaaggctgaattactcctactgtcattgctgttggttttcattgcagtagatgtttaggtttccatttcttcctccccttatcatttactaacttactataggttgaccatacctcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaactcgctgagctcactttctcctctctctctctctctctccctccctctccctgtctttctctttcattcttttctacctggccctggtctatcccaacataaaggcaataattcattacctcattaatggatctgtcctttttctttttaaacagttccttatgttagccatgaaatctagctggggctgtgtggtttctgattccccctggcttattctttactttttcctacttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcattgccgcaggcaggacctatgggcgcatataggttgtaatgaaactgtagtctcagttggaagcctagacatgaaatgggtcagtgagcaaggctctattcctagtctccagccatgcctgtggcaagctgagcccgctctcagcacattggacccaggcagatgtaaaaaattcacagaactatgatttggactgaagggtttgtagatttcttccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatggggatatttcacccttggttctgagatgcaaaccaaagaatatcatgaccagctttcaggcctcctgaagtatctctctcacattgtcctgttctcatgctgaggagcctgagatccctgtgtggggattagacagtggactgttatgggtgtaggtgaattggcttattttgtctgtccctgtctgaatgtattgcaggaactaaaaaggaccaagaagaggaagaagaccaaggcccaccatgccccaggtaactgagcaattgtgaacagctacttctgtgttgacatctggagactcctggttcagggaaaacagagcgggctgacattatcgattaaatcttttccagcaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctctgtgtgtgtgtgtgtgtctgtgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccaggcaagggatgggtcagtgagcaagactctcttcctagtctcaggccatacctgtggcgccctgatcctatcctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcataactgtttgcacaaacttgggacaaatgatattgggataacgatctactagaatagggacattttacccacagtttctgggagaaaaaccgaggaatttctatcatgaccagccttcaggcctcctgaaatatatctctcacggtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctgtgttaacacctggaggcaacagattcagggaaaccagagtgtgtttgatgtcatgttttcaacgaaggctgaattactcctactgtcattgctgttggttttcattgcagtagatgtttaggtttccatttcttcctccccttatcatttactaacttactataggttgaccatacctcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaactcgctgagctcactttctcctctctctctctctctctccctccctctccctgtctttctctttcattcttttctacctggccctggtctatcccaacataaaggcaataattcattacctcattaatggatctgtcctttttctttttaaacagttccttatgttagccatgaaatctagctggggctgtgtggtttctgattccccctggcttattctttactttttcctacttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcattgccgcaggcaggacctatgggcgcatataggttgtaatgaaactgtagtctcagttggaagcctagacatgaaatgggtcagtgagcaaggctctattcctagtctccagccatgcctgtggcaagctgagcccgctctcagcacattggacccaggcagatgtaaaaaattcacagaagtatgatttggactgaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatggggatatttcacccttggttctgagatgcaaaccaaagaatatcatgaccagctttcaggcctcctgaagtatctctctcacattgtcctgttctcatgctgaggagcctgagatccctgtgtggggattagacagtggactgttatgggtgtaggtgaattggcttattttgtctgtccctgtctgaatgtattgcaggaactaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttccagcaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctctgtgtgtgtgtgtctgtgtgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccaggcaagggatgggtcagtgagcaagactctcttcctagtctcaggccatacctgtggcgccctgatcctatcctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcataactgtttgcacaaacttgggacaaatgatattgggataacgatctactagaatagggacattttacccacagtttctgggagaaaaaccgaggaatttctatcatgaccagccttcaggcctcctgaaatatatctctcacggtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctgtgttaacacctggaggcaacagattcagggaaaccagagtgtgtttgatgtcatgttttcaacgaaggctgaattactcctactgtcattgctgttggttttcattgcagtagatgtttaggtttccatttcttcctccccttatcatttactaacttactataggttgaccatacctcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaactcgctgagctcactttctcctctctctctctctctctccctccctctccctgtctttctctttcattcttttctacctggccctggtctatgccaacataaaggcaataattcattacctcattaatggatctgtcctttttctttttaaacagttccttatgttagccatgaaatctagctggggctgtgtggtttctgattccccctggcttattctttactttttcctacttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcattgccgcaggcaggacctatgggcgcatataggttgtaatgaaactgtagtctcagttggaagcctagacatgaaatgggtcagtgagcaaggctctattcctagtctccagccatgcctgtggcaagctgagcccgctctcagcacattggacccaggcagatgtaaaaaattcacagaactatgatttggactgaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatggggatatttcacccttggttctgagatgcaaaccaaagaatatcatgaccagctttcaggcctcctgaagtatctctctcacattgtcctgttctcatgctgaggagcctgagatccctgtgtggggattagacagtggactgttatgggtgtaggtgaattggcttattttgtctgtccctgtctgaatgtattgcaggaactaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttccagcaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctctgtgtgtgtgtgtgtgtctgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccaggcaagggatgggtcagtgagcaagactctcttcctagtctcaggccatacctgtggcgccctgatcctatcctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcataactgtttgcacaaacttgggacaaatgatattgggataacgatctactagaatagggacattttacccacagtttctgggagaaaaaccgaggaatttctatcatgaccagccttcaggcctcctgaaatatatctctcacggtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctgtgttaacacctggaggcaacagattcagggaaaccagagtgtgtttgatgtcatgttttcaacgaaggctgaattactcctactgtcattgctgttggttttcattgcagtagatgtttaggtttccatttcttcctccccttatcatttcctaacgtaccataggttgaccatacttcaaaagctgtactctcatggccactgcatcgaattttgagcatattttatggaaaactattgagctcactcttttcatgatcacagtttgctgtgtgtcatgagggcactaactcagagtgtccttttactcccttaccagtatgtcacctggccaattcactaggtcactttctctctgtctctgtctctgtctctctctctgtctctgtctctctctctctctctgtctttctctttcattgttttctacctggccctgttctatcccaacataaaggcaataatttgttacctcattaatggatctgtcctttttcttttcaaactcttccttacgttagccatgaaatctagctggggctgtgtggtttctgattccccctggcttattctttactttttcccacttttccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatggtgagtacctttctatgaaggtgataaggatccactgagtcttctggttagggtcatattcctactgcaagtggcccttactgagctgagagatgtcattgccacagggaggtcctataggcacatgtaggttgaatgaaactctagttccacttggaagcccagacaagggatgggtcagtgagcaaggctctcttcctagtctcaggccatgcctgtggcgccctaatcctactctcatgacgttggacctgggcagatgtgacaaattcacacaactctgattttgtctcaattttgtagatcttgtagatttcatccttcactctaatttcagcgtctaaaatcctcgctaccgtgaacaatctgagtatttgatgagacagggctgaatagtgcagtttttctcctagcaaccatttgggggcatttgctttaaatcgattggaaaaatatggcataaccatttgcacaaacttgggacaaatgatattgggataacgatctaccagaatagggaattttacccacagtttctgggacaaaaaccaaggaatctctatggtgatcagccttcaggcctcctgaagactatctctcacagtgtcctattctcatgctgaggagcctgaagtccctgtgtgaggattagacagtggattgttatgtgtgtaggagaaccagcttaatatgtctgtccatgtctgaacttattgcagaaattgaaaagtaccaagaagtggaagaagaccaagacccatcatgccccaggtaactttgagcaattatggatgcttaattctgtgttgacacctggagatgccaggtccagggaaaacaagagtgtgttcaatttcatgttttcaacgaaggttgaattactcctcctgatattgctgttggttttcattgcagtagatgtttaggtttccatttcttcctccccttatcatttactaacttactataggttgaccatacctcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaactcgctgagcttactttctcctctctctctctctctctctctccctccctctccctgtctttctctttcattcttttctacctggccctggtctatcccaacataaaggcaataattcattacctcattaatggatctgtcctttttctttttaaacagttccttatgttagccatgaaatctagctggggctgtgtggtttctgattccccctggcttattctttactttttcctactttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcattgccgcaggcaggacctatgggcgcatataggttgtaatgaaactgtagtctcagttggaagcctagacatgaaatgggtcagtgagcaaggctctattcctagtctccagccatgcctgtggcaagctgagcccgctctcagcacattggacccaggcagatgtaaaaaattcacagaactatgatttggactcaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatggggatatttcacccttggttctgagatgcaaaccaaagaatatcatgaccagctttcaggcctcctgaagtatctctctcacattgtcctgttctcatgctgaggagcctgagatccctgtgtggggattagacagtggactgttatgggtgtaggtgaattggcttattttgtctgtccctgtctgaatgtattgcaggaactaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttccagcaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctgtgtgtgtgtgtgtctgtgtgtgtgtctgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccaggcaagggatgggtcagtgagcaagactctcttcctagtctcaggccatacctgtggcgccctgatcctatcctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcataactgtttgcacaaacttgggacaaatgatattgggataacgatctactagaatagggacattttacccacagtttctgggagaaaaaccgaggaatttctatcatgaccagccttcaggcctcctgaaatatatctctcacggtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctgtgttaacacctggaggcaacagattcagggaaaccagagtgtgtttgatgtcatgttttcaacgaaggctgaattactcctactgtcattgctgttggttttcattgcagtagatgtttaggtttccatttcttcctccccttatcatttcctaacgtaccataggttgaccatacttcaaaagctgtactctcatggccactgcatcgaattttgagcatattttatggaaaactattgagctcactcttttcatgatcacagtttgctgtgtgtcatgagggcactaactcagagtgtccttttactcccttaccagtatgtcacctggccaattcactaggtcactttctctctgtctctgtctctgtctctctctctgtctctgtctctctctctctctctgtctttctctttcattgttttctacctggccctgttctatcccaacataaaggcaataatttgttacctcattaatggatctgtcctttttcttttcaaactcttccttacgttagccatgaaatctagctggggctgtgtggtttctgattccccctggcttattctttactttttcccacttttccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatggtgagtacctttctatgaaggtgataaggatccactgagtcttctggttagggtcatattcctactgcaagtggcccttactgagctgagagatgtcattgccacagggaggtcctataggcacatgtaggttgaatgaaactctagttccacttggaagcccagacaagggatgggtcagtgagcaaggctctcttcctagtctcaggccatgcctgtggcgccctaatcctactctcatgacgttggacctgggcagatgtgacaaattcacacaactctgattttgtctcaattttgtagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcacaaagaattgtgtatttctcactgcatcttgtggtcagaaaagtttgagaaactgctccacataggcaaattataggttcaatctatccgtctacctctttttctcttctctttttttccatgctatgcaaacaagaccatggagagaggaaggcaaattccatcaatgggtggggttaagccttttctatgaggtagctgcacatttgggacactcctatgctggcgacttgacattctagtagatagattgtccttttcatctttagctacatgttaaaattacttgggagcattttaagactactagtgtcttccacccacctggaagcatttaaatcagaatctctatgtgtagagtccaggcacttgtgttagttaaaaccttactaggctttataatatgacagaatggtttaaagctactgagtagacctaccctatttcccaccattttctttctttctctttcaccataggcttctttcccatgagaaagtaaagattttagtctctcttttcacagtccgaagtaaatcactatctttctcaactggacttccaaggcaaagatttctctccatttacctatctggatttttacaaagttggcctctggattcccttttcccaaagctaattcaccacaaacgcacccctcaagtcaaggagctgggctttcatacacctgcacctgtcaatcatgggtaaatactttgcaggcagggttgcatgtgggattgacataaactaccaggtattgccagctctgagcctcaggcaagcttgtgactaagtgactccagtagtctgaggacagtccttactcagaagggtctttggaagcaaaagcaaacataggcatgagagggtaaaaaaaaaaaatcccatgtgattttggcttatacctaacagaacttgtgcaagaatggatattaaggtgggtattgtacacagcagagcttagtaaataccaagtctgcagtttaagggataggctgaagagattttgcaggtttgtaaacatttttgccaatttgaacatacttttgtttgcgtttggtttttctcctcagtggtaagagctaggcacgataaggtagctagtatattataatttcaatcaataaatttttattttgccaaggaccaagatgaactacgacgatttcaattatttagtactttattttcataagtttgaaaattaggacttttgctcttttttggctcacggcatctttttggatttcacactttctcaaaggccagtaacttagaatctaaattatgattgcttattctttcagtattctaggggaaagttgatttaatcttgacaaaatgtattcaattaaaataattgttctcttaaatcttttctgtctttcttttctttttttttttctttttttttttgagatggaatcatgctctgtcactcaggctagaatgcagtggcgcaaatttggctcgctgcaacgtctgcctcctgggttgaaatgattctcctgcctcagcctcctgagtagctgggactacaggtgcatgccaccacgcccagctaagttttgtatttttattagagatggggtttcaccctgttgttctgttaaatcttttcaccttttaagtttgtccttctcttctccaatttgcaagagtggggtgtggctcgcaccgaaatactgtatttcttagagctacttattcctggagcctggcagtctgggggcctggagggggtgtgtctagaaagcagccctctctaagttgagaatagctatgagaattgtgggttataaggttttgagcagctctggcctccccgtcctcttttatttctacagtggagtgtggcaagagaagggacccatctgagagtgacttcatattgtggcctttcaccacttacctctggaaatttgattcaggcaagtcgggagagtctccggtattcttctctgagaactctgttttcattatacagctggacaatggaatctatgatttgcctgtagaggttagaggtgcatcctgttccaggaaattattacaatttatgcaagttatacacgtttgcttaagagaatgctttctgcacatttcatgttcttcctctctatcttagcctagggagaaaaccgtggagggctggaacgttagtgtgatggggtggaagcttaattttcacatgattctcaacaaatgccagcacatcacatgtattatcatgtccaatggctgcaatatgaaggaggcttttccaaaatagttacggctttggtatgggaagggacctgcttatggttcttctggcccagcacaatgttatgaaatgatggcctctgtgtgagaacaatctaagaggaggggggttggagagaaccaccttggggtggtagaatgaagagtcaccaagacataagggaagctgatgaggatggcagtagaggagactcattctgctatgtgaggtgctcagaaacctgggttctactgaatgccaatcacataagaagcagagagacagcaggcagtgtacagcagcagacagaagacagcagacagcttaggaatcacaagaatgattttagaagtagatacctctaagatgaaggcatatctttaagcctatttatttacctataaataggaatgatagtagctgccctgcctctctagctgggacatttgtaatgaataagtgaagtaaagtatgtcaaagtgtttgaaatctataaaactctgccccagtcacacgcctttagaaaaatacatattgccagaagcaggctgacttgggcctctcctaccattttcttcatcaaagctgctgtgatgacgttctagcttttctcacaggcagttgttgatgaaaagggtctccttcaggtgctgccactggctctggatctcatcttctgcagccattccaccaggacatggaatgagatgggaagtgaagatgctgatcactaaagggatagtcaggggcctctcgtcaagatccctgcctttcaccattcttttgccaacttcatcttctcatcagggaacataaggcaactttctttaagagcttttaaggtttcaaagaaagcatggccaagtgctaagcaaactccacagggatgcctcccacatggagatatgggaagtataaggcaggttgacaggaggtgggaaaacactgaaggtctctgagtagggcttttctagcactagaaaaggtatgaccacttccttgagatgacttataggtactagggaatatcttcctctctacaaaatatctctcctgaacatattttgtttttgttgttgttttttgacagagtctcattctgtcacccaagctggagtgcagaggcaccatcttggctcagtgcaacctccgtctcccaggttcaaaggattctcatgcctcagcctcccaagtgactgagactacaggcgtgcaccactatgcttggctaatttttgcatttttagtagagacagggtttcagcatgttggccgggctggtcttgaactcctgatctcaagtgatccacccacctaggcctcccaaagggctgggattataggtgtgggccaccatgcccggccctgaacatctttaacagatggtaaagaccttcttctgcaccattactgtgaaattggaaagagaaataaggatgcctttgtcagaagatggtatgactaattaaagccacaaacttacacccatcactgacagaatgacaagcctaatatggtttatattactgtgaaagctcaatgagtgaattaatataatctctttttattgcatagaagagtatataaagcatatagtctcctaacaatccaaacttttgcccccaaagtaaagtcaaacattcaagtaagggagaggagatataggtcaaggttttaatctatacacacaccagagaggctaccaaaccaaagggctcttatatacctaatgaagctccaatggctagcgtggagttattctgggaagagggcatgctggcggcattgctcttagattcagccttttctccagcagatagcctcattgtttatttagatggaattacaacactgagacgaaactaacagacatcttaaaaataccttggtgctgcacaaagattgagaaccctggctatttaccaaagggttgccaagatcaaagtcttgtctttatggaaatcccctgatattccagtagtcagatggaaccttatgggaaagcaagcatctgaggggagatggagactggagcttgaaacccaggaaccattataattgcacctccaaacatatggacaagcctgccaacattcttgggatggctagaacagcttgggaaagctgttcaggaactataattatcaagagtatttcaggaaggctgggtgcagtggctcacatctgtaatcccagcactttgggaggcaggggtgggtgaattgcttgagctcaggagtttgaggccagcctgggcaaaaaggcaagaacccatctctaccaaaaaggcaaaaaaaatagccaggagtagtggcatgcatctgtgttttcagctactcaggaggctgaggtgggagggtcatttgaccctgggttttaggttgtggtgagccaagatcatgccactgcactctagcctgggtgacagaacaagagaccctgtctcaaaaaatatatatatttcaggaaagatgagatgtcccattttaaagaagaagatctgttaaacagatttgtacatgcgcggcagtagtggcagagagtctgccataatctcttcactctctccattctggcctgctttgagtataccggcttgcagatgccggtctggaccagagggactgaggtgaggacaggaacagagcaaattacctgacacaccagggacctgtacttgagagttgatcccagagctgtgttcagcctaatcacttttttaaagtgaatgtttagggcctgcctgcagagaataacatctctcagtttagacagaggtggtgagcatgtagaatgtaggagctactgagagattgatggagctttatttttcttatcaaaggagcacttactggctgtttccacagccgaggggccttcctgtgcatcaaagaggaaggcattgctgctgggaagctggtgggagtcatggcagctggaatgagtcaaatactgttcatctagtgagtactccaggacttcatccatttcttcctcctggacttccctcttgagccaggtgaagtaggcaagacaagggattaaaccaaggcagcctggaaccacatagctagttctgatctgaagctcatggaagaggcaccaaaaccaaagggaccatcacatcaaagaggaagtatacagtccacttttgactgggagtaaagtgtgcctagagttagtatagaagtgaaaaaagcaagtgatcagtgcattgacctcataacacacagataaggcagcagactcaacaactactctacaatacgctcacggcacacaggacacacagtgacccatactgtcggcttcaaaatgctgtgtttaaattttatttaatatgatgtggagtggtccactgaatactggctcttgagacaacacaacctcccacggcttttgcagattttagacccctagctctaaatacttggtatggtttcaatttatttttcaaggtaaatttctggctataaaatatctgccaacataattcaggacaactgtgcagaaaccagataggcatctcactttggtttgtaaccctataggttttaaagatacagaaaccagggatccctggttagtttacttttcggtaagactgactggttaactaagtgtgagaaattactaggaactaggaaccaatacaaaaactgcaaagagaacagagaaccatttttaaaaggacacattgtataatcagtcaacaaaaaaaggaacaatcagcagtttctgctttttctagatctgggacctttaacctcttgagtccttgcttctggaattctctctagatttggtcagtccattatcagccccttcatcatgtagagttacctgggagccagtggcttttgcctgtcttcatttttcttaccattgtgattttctgcaaaccaaaattagaaagagctagtcagaaattaagcaggtcccatttcacacattgcacacatgggccctatatgatcagggacataacagcttacatgtatgttcagaatgctctgtgagaattattgcaggaggcctcaggttgtgtctttagagaagtggcctggcaggcttgccttagcccactggacagggtgttcctgatatggtgaatcatcaccagacgtcagctgcctgaagcagagcaaaaagttttaaatgccttttgttccccagctcaaagaatacttgcctggctgccctttggacttctccagttgtaaccttccttcctgctacaggctggttgccagaccacgactgtttgtcccattgctactcacacacagaacctgctccagtctctgagaggacaaatagccctgtcctacctctactccaaaaccagaggactgcccaggtgccttcaagtctgtccctgttgtgcttcctcagatgttgttgggggtaattcttttttttcttctcagtttgttagtgagcattggggttgattctgtgaaaaatattccagtataaatcaacttttctaacaccagcttctactatatacagtgcctgaactaaccccaaaagatttggacggtttattgggacccaaaaataaaaaaataaataaccctgaaagagaaatacactcatgaacattaagatactacttcaactgatctgtacagcagccttggaattatgatttgacccactttacaaatggggaaacagaaattcaagaaggatcaatcacttgcacaaagttagtaaatacagtgctgagactagagcctaggtaatgctgattcttagcccatgggtcttcccattctaacaagctgccttctgtcatactgttctttctgaccacaaagatggaatggagacttctgcttctggccaatttggagtaatggggacctgatttgtcctccaccttaaacaactgagaaactggaaaaagtattttaaactctatcttcaacattggatatagtgcagtactataataaataaaagaggtgagccctatgattgctccagtttgctgcctgagattgtcaactgtagagcagggagggaggacccaggcagagcctggtagtaactttgaagaagacagggtggctagacatcacaggacagactagagaataggttgctgcacagatagaatgccttggatatctgtcttcaatcttcagctaagtactgattagtacatgtatttgaggaaattatgcaaagcagggcaaagaacttcccaaaaggaataatctctgtagctcacacatagcttgcaacacttggtgtttccatcagctagtgtgaaaatcccttttaatagagggagcattggttagaacaggagtccccaacccccagcactggtccatggcctgttaggaatgggaccgcacagcaggaggtgagcagccagcgagaaagcattaccgcctgagctcagcctcctgtcagatcaacgatggcattagattagcatcggagcacaaaccctattgtgaactgtacatgccagggatctaggttgcatgctccttatgagactctaactagtgcctgatgatctgaggtggaacagtttcatactgaaaccacccaattcccaacccctaccaccccacccccaccttgtctgtggaaaaattgtctttcgtgcaaccagtccctggtgccaaatctgtgggagatcactggcttagaatcttcaaaagagtattgcccccaatgtaaactatggactttgtgtgataatgacatgtcaatgtaagttcatcaactgtaacaaatgtgccattctggagagagatgttgatagtctaggaggctatgcatgtgtggaggcagggggtatatgggaactttctgtacttcctgctcaattttgctgtgaatctgaaactactctaaaaaataaggtctattttcttaaaggtcattttgcctccatagtgggaaaaaaaatagcagttgactaatagctgctcttatgctgcctgaaaaaaattaaaaagccagcttggagagatgaaaattgtttttaagtaactttattgtataccaaaacaaagctcaaagaattttaacacaaaatgcaaaaaaatccagcacccaataagttacaatgctcaatgtctaaccccaaataaaataatgttaggaatgcagagaaacagaaaactgtaatccatgataagaagggggaaaaaaatcaatctacttaaactgacttagaaaggacacatcaggtgagaattaaaaaacaataaaaaggacacagatgagagaatctgtagataagcacattgaaacaaatataactgtataccttgtattaaagaagctaggccagtgtggtggctcatgcttgtaatcccagcactttgccaggccaatgtgggtcacatgaggtcaggagtttgagatcggcctggccaatgtggtgaaaccccgtctctctgaaaaatatgaaaattagctgggtgtggaggcatgtgccggtaattccagctactcaggaggctgaggcacaggaatcacttgaacttaggaggtgaatgttgcagtgagccaaaatctcaccactgcacttcagcctgggcaacagagcgagactctgtctcaaaaaatagaataaaataaaataaagaagctagaggaaaatatgaaatgatgaagagttacatagaagaacttaaaaaaagacataaattaaatttagatgaaaaataaagtctgagatgaaaatacactggataggattaacagcagattagatgctgctgaagaaagattaatcaattccaagacatggaaatagaaagaaacagagagaaagaaaagatacaacaaaaatgaacagaccattagtcagctgtggtaaaatttcaaagcagctaatataaatataactggagtctttgaaggagaagatagagagaaagaatagaatatacattatatatatttgatgtatatatgccaaatataatatattgtatatgccataggtaagactatgtatgtcattattattcaaatttgatgagaactataagcatgcagatgcaagaaactaaataaagtagaacaatatgtaaaagagaaaactatacaaggtcttatcttaatcaaactgcttcaaacgagtgataaatagaaaatctcaaaagcatccagagaaaaaagacatattatgtacagagaaacagaaataagaattatggcagacttcttgttggaacagtgtaagccagaagacagtggaatatcacttttcaaacacttttttaaaacaaaaactgtcaactagaatcctacatccagtgaaaacatcttccagaaatgaaggtgagttcttatgctcatcaagatgaagtaatccactatactctacctctcttactgattgaaactaagaactctcaggccaggcacagtggctcatatctgtaatcccagcactttgggaggccaaagcaggtggattacttcagctcagtagttcaagaccagcctggacaacatggagaaaccctatctctacaaaaaatacaaacattagccaggtgtggtggcacacacctgtagtcccagctacttgggaggctgaggtgggaagattgcttgagcccaggaggcacagattgcagtcagccaagatcatgtcactgcactccagcttgggtaagagagcaagactctgtctcaaaataaaaaacaaaacttagaattctagaaagaatatgaaaagtgattacctgagtgctctaaagagaaaacaatagaatgcagattaaggaccatagtcaaaactaaaataaaatctataatggagataagtttgcattttttctccccactttggggcacttgggaggagctaagggtcttcagagcctgtagccaacttacctgtggcaagttttctgacaaggatctctgtcagctggcttccttgtaccatttgctcacagaatctctgtctctggtagtaggcaatgtcagtgttcctgagaaggccctcaaaagacttgactgtgttcttcacatgctgggtgaaaaggtagcagacacctctcccttcctgtatcttctgttgtaagtgggtcagttcttcagcctgagcctgaattaagggatcatgtatcctaaggtgggaaagaagagtaaaatgtatgagggaatgtagtgaataataggttatagaagtttcagaggagagatctcttagaatccctgtaaggaactcccaagttgaattctttttttctttttttttgagacagggtctcactctgttgcccaagctggagtgcagtgatgtgatctcggttcactgcaacctccgcctctgactccgcctcccaggttcaagcaattctcttgcctcagccttccaagtagctgggactacagatgcccaccaccatgccaggataatttatatattttttgtagagatggggttttgctatgttggccaggctagtcttgaactcctgacctgaaatgattcatgcacctcagtgtcccaaactgctgggattacaggcatgagccactgcacctggcccaagatgaattcttgtacaagttgtgtgacttgcctgtggcagaaggaatgaagaagcagccttgggtttgtctgttattttactaaatttcctttaaaaagatgcccctttggttccccactttagcccatgtaccttttcatatgcagtaactggcagaaaaaaaaaaaaaaaaaagccaagttcaaaactgttgggccggtatctctagtattaattgaaagttaaaaagaaaaatcagtgaaaaggtcaagaggggcagtattcttctgaatgacatgaagatagactataatcagtaagaaggcagttaaaactaaagttctggccgggcacagtggctcatgcctgtaatctcagcactttgggaggccaaggcaggcagatcaccttaggtcaggagttttgagaccagcctggccaacatggcgaaaccccatctctactaaaaatacaaaaattagctggtgtggtggtgtgcacctatactctcaactgctggggaggctgacctaggaggatcacttgaacctgggaggttgaggttgcagtgagctgagatcacaccactgcactctagcctgggcaacagggtaagactccatctcaaaaaaagaaaaaaagtaaagttctgagtagtaatttcattactctgtgcggatttattttttttctaattattgtttaaatatttctcatggtgatatggtttggctctgtgtccccactcaaatctcatgtcggattgtaatccaaccagggacctgctggatagtgactggatcatggtggtggatttcccccttgctgttctcatgatagtgagtgagttctcatgaggtctggtcgtttgaaagtgtgcacctccctctttgctctctctctctctcctgctctggccatgtgaagaccatgccttcttcccctttgacttctgcaatgattgtaagttttctgaggcctgcccagaagcagaagcctgtacagcccacagaaccatgagccaattaaacctcttttctttataaatcaccaatctcagatatatgtttatagcagtgtcagagtggactaatacacatgggttccaatgtagagtgtgagctctgtgagtctaaagatagtgctacctattacccaacttacagcacccggtagtatgtacccatacaagtagttattcagttaatgtttagaaccatgtaatcccagagctagactgaacatttacagtcatctaacccatctaatgcttgaattttctccccaccagtcttctaagtagttatctgcaggtcctctttcaaactctatttcttagagttactagaaagtgtcagaggaagtaaagacacatactggggagaaacaggggctccagacctatcccaccttcaatcaaatatctctgctttggtgagttttacaaatttgagcttctatgatttcatttcaacaaaggattaaaagaagtttcgaatgcgacaatctaccttatgtctgaaaccctctaaggatagtcaatgctggtcctgagcgaattaataattcattttccacacaacagctgctcaatcatctatctacccaacagccctaccagttaatactccacctagtataatacttttttaaaaagtttggaggagaaacattgttatcatgaaaggcactttggaaagtttgaaaatatctcttatagaaaatattaatgacaatcaccacatctataaatggggacaaatataataattacagaaaatagttgttcagagttttatatgtgttagagatggttctaactacttgcaattgtgcatttaatcttcataaccctctaagtagatactgtcagtatttgcattttataaatgaggtagcctagtttaatgacacgcagaaaagtgaagtaaatttgaccaaggacacacaaatagaagccacattgctagtattccaatgcagacagctgtctccattttactaatatgctatttaatggaaaaccctagagacctaactagaccataacctcattgtgtcttagtctagttctgtgcctgagtcatacatttctgcccttctccttgcacaaatttgctctttgttctaccagcctgagctgccctacttcaaacagtatttatgcacttcccacagaggtacctccttaccggagccttgcagctgacctcggcaattcggccagctccctctcctgaaactgcacctcctcctccagcacagattctataaggtctttgcactcttcacactctgagaaaagatagacatgcctgcatcatggaaggctggccatgctgctgtggtcactgcctgcagggcaggaggcagggtctatctcaaggataaaagtatccccagtacgaggctttacgctgggatttccatatctgtattcctcagtctctcaactactccctgttttagagatgaggaaagaaaagcctgataaagtcacttgacaagatgattcagctggaatgaggcagtcagaattcacatcccctgaggtctgacgccacatgtttttcttttctttttttttttttttttgagatggaatctcacttttttgcccaggctggagggcagtggcacaatctcggctcactgcacctctgactcccgggttattctcctgcctcagcctcccaagtagctgagattacaagtgtgtcccaccataccctgctagtttttgtattttcagtagagacagggcttcaccatgttggccaggctgctctcaaactcctgactgcaaatgatccacccaccttggcttcccaaagtactgggattgcagtaagtgagccaatgcacccagccatgacttcaaatcttaaggccaatttaccaagccttacagcctcttaagtaaaacatgaacataagggcatgaaataatgacttcctgtgtgtttgggaagatactaagaatggtaggactgatggtcctcctgtgtcaggagtttcaataatcccaaaatatttcaaagatttaaacatttatctgtatacagctgtgtaaaactgtatatagaggagaaagatccaaatgatatgtgcccaaaagctaataggtggtgttttaaagggagaaccaacacatagtgtttgtcatggtactgttgcagtaggtttttaagaattatcatcatatgatcatcaccaccatccaaagaggtagttcctactctattaccattacagatgagaaaactgaggcacagtgatgataagttagatttgaacccaggaaatttggccccagggtatatgctttttaatcactgcacaataatacctttatactagggtcttaggtaatatctttcttcttctctagcttgagaaatttttttcctacaattataatgagtgaaggttttttttttaaactagtttttccacacaccaaagctcatcttttcacttctttaataagtgggcttttggttttacttttctatgacagtaagttagacagcaacttttagccaccccccacacaatgatgtattttaaaataattgtagaaattggaaaacaaactcaatttctatgttaaccagaatcctcttctaatatccctgttcctctcatgcccttgttcccatgtttccttgtcattacagcttcccttccctgactattagtaacaggtttgggattttacagtggatttaaaaatgtgagagctaactgtggagaggaaggggccagcccctaacctggcctggccttctattgagaatggcagtctgttccacttggccttgttctcattttggccatatgtctcatagctctgatcctggatgtccacctgcagttgcttgctgtctgtaaagttgatactcagagagagacagaaagggtgttacaaagtctctgatttttctggaaataccctcaatctaaccagagcatgaggaatggcttatctgaacttttgtgggaagagaatcttgatccaggtatcataaagacttttttccatgtctgctattgaagttcacatctccacatatctgtgactcagttgagaatagctagttttaagttccttcaaggcagatagggtatactattacttctatcacccctgatgctgttggcacagtgctttgcaaatgggcgctcttaaaaaagtttaaatcgaatcctgagatgttttaaccaacagtgatgttacatgtttgtggaatctgatattcattgctgagaggggaaagacagtttcatgcctaaaccaaggttttagtctctattcctcactacactcaccctgcaaactttacacctttgtgcctcagtttttctgtccttggcaaattgagagtaaaaggcccacttctacctttctgggagtgtagttagcataaaattaattttgatagagaataaagtccgcagtgtttcatttcacagaggaaagatgggcaatcatttatcactttggtgaccatgcccctttgggacctactacatttctgcaggtgattggccaggcagtaggcagtagctttggatgtcaggaatttctctgtgaggtcttggaagttctgtttgcacttttccagttcagagcgcaagtactgattggtttccaggatgctcatttctgcccttggaccaaaacaagtggtggcagatactgccatgctgaagcttgtggtggaagtagaatcagaacccagacaaataataaattaaaaacaaatgcatggattatggtaatggttgcactacttgggtaaattactaaaaattattcaactgtacaattataatgggtaaattttatagtatgtaaattatacctcaataaagtttctttacattaaacaaaggatttaaatgagtcaaaagaaagcagatctgattcataacttacttttgggataaatttcatcagcatcccgcaactctgagaatccttagccacaaaaacaagacaaaggtatctaagcttagactctaaggtactgtctgtggttcaggctctgataggaatgccagaggtaagacccagtgccaggtaatggtctggagtcacaatcagaattagaaggtgggggtgtcatggaatgttaggatctctgccttccaggtgtctaggccatgtggaaacacaggtctcttctgaaggtcaccaccaatggagaccactgcctcagcaagtcaatctcagtatttgtatacccttgtgacaataccacaggcctatctctttctaaaattcaaccatattttcattgtttattattgcaaatgcatagaaaacatcaaggaatacatatttccccaagttctatcgctgtcttaattactatcatgaattcattttcttcctaatgaaaaatttaacacttttagatagtcttggtgttcttctttggttctccagatttccacatcatttatattataagaaaaaaatcctgaatattcctctcagtgtgtgaataattgacttatatcgatttagaggccaggtgcagtggttcacacctgtaatcccaccactttgggagaccagggttgttggatcacttgagctcaggagtttgagaccaacctgggcagcacgacgaaaccctgcctctacaaaaaaatttaaaaaattagccaggcatggggctaggcacggtggctcatgcctgtaatcccagcactttgggaggctaaggcaggcagatcatgaggtcaggagatcgagaccatcctggctaacacggtgaaacctcgtctctactaaaaatacaaaacattagccgggtgtggtggcaggtgcctgtagtctcagctacttgggaggctgaggcaggataatggtgtgaacccaggaggcagagcttgcagtgagacatgattgctcactgcaagcttgggtccaggtgttttttgctgtagtgaaccaagatcatgccacggcactccattctggatgacaaagtgagaccctgtctcaaaaaataaaaacaaaataaataataaaaggattttggtcaatatcttaatatacttcttgctgcaaaccaatgttatactgacatatttcccccactggggaagcatgttagttttttgtttttttttttgcttttttttaatagaaagggtctagctctgctgctcaacctggagtgcaatgacatgatcacagctcactgcagcctcaaactccgaggcttaagtgatcctcctgcctcagcctcctgaatagccgggactgtaggcacatgtcatcacactcagctattgtgtgtgtgtgtgtgtttttttgtgtgtgtgtttgtgtagatggggtctcactatgttgcccaggtgggtctcaaactcctgggcccaagttattctcacactttggcctcccaaaacattggaattataggcataagccaccacacctggcccatgctggcttttcacttaacttgaggacaagcttgatattcataactcctaaccccactctcctcttctatgtgtggtttgcttagtgttataatctctgtatacatattttgtgcttgtcacttatgattttcattctaactccacatgctttctttccaatttgtcacaattgctgaaataatttatgtatatctctttaaatacatgtagttgccacctaatttggaatgacttataaactgttactattttatgtgtttgaagcagtttttatggaacactaatgatttgcattggcctgaggatatattctcagacaaagcatggtaaaaatcaagttaatgagtctgtggtggttggcggtgatcaacagttttcctgtgcaatggggtttagtgggatagaaactgaggttttaaagacaggcatagataggcagaagagaagtcatcccctgatgtaactcttcacttcctatgtatcaattcctccctggttttttgagactgagatagggagactcttatggaatatctgtcctttcccttcagctgcctgactttcctgggctactggcctacacatgtgtaatcatggtcacctccacattcatgacaaacagaaggaagcaggaccaacaaactgcataccctacatgctaacctgaaactatagtgtgtgatagtattagtttatgagatatatcagaagttatatgattttagtccttttaaatttattaagatttattttaaaggctagcatatggtctattctatagaacatcctgtgtgtacttgagaggaagtgtattctgtttttgttgagtggagtattctatagatgtctggtaggttatgttgtttaaatcttttatttctttattgatcttctgtgtagttgctgtatccactattgaaagttgtggtattaaagtctccatctactattgttaaattgtctatttctcccttcaattctgtcactttttgcttcctgtgttttgaggctctattagatgcatgtgtatttataattgtactctcttcctgatggattaacccttttatcattacaaaatagccctcattgtcttcagtaactttttttgtcttaaagtctcttgtttattttgtctggtattaggatagttgctactgaaacaccagaggtttgatttaagtcttgctgttcactgcacagaaagccaatcactgagtcaactagctttgctaggaaagaaggctttcatcaggtactacaacttaggagatgggagatcagtctcaaatccatcttcctgaccaatgaaaattcagggtttagatagcagggaagaaatggaactacatacaggaaaacaggaattagggagaggtaagaaagaggaattggtcaacaggaagcaggtggtcacttaggcaattttgatgggataaggggtctgacatttcattgtccagatgtggtactctggtaaatttcagttctttgatactatctggagggcccaacgcttggtttcctgagaaaggaactcagataatacaaatgtaactttctcaaatttcaagactgaaagggtcaatttctatgtttattcaaaagaaaccgtaaacatcagttctatgggacaattgggttggtttaaaagtcacttcagctttcttatggttgctaattacataattatattacattgtatggcaaagggattttgcagatacaattaaccttaaaatggggagattataaaggttgactaatctaataacatgggcctttaaagtctggatctagaggtcagaggtcagcaaactaggaagtcagagagatccaaaacgtgttagtgattcaatgaggaagaaactcttcattgctgactttgaagatggtgagagtcacaaataaataaagtcctcagtccaacaacttcataattagtgctacctgcaaatatgggctaacaatatttttaaatgcatttacaatatgtggtgaacagattcacattgtctctgcctactcttctcttttgctttgtccctgcatgctactatgtctgtctagatggggggacacaaacatcagggctttgtgcagacttctttcctttcctggaatgctatggctctctagagccagataacactgctgaaggtggctgagtacaggcaactgatggtgttagaagccacaggcccttgattaatccaggctctaatcttcacccacctcaaagtcctaagagtcctccttatagcttcctatcagatttatacagattattacccacaaaccttgctcttccttggacccctaaggccagggcttctaatatcttcatcatttttgaggtatctaataactcttctttctggagtttcagttacttcatccccactgctgagtgaaaagttaccagatgactagcacaaagtctcatatgcaaatcagggctaaacagcgagtggatgatattttgtctagatcagccatgggtattgtcaaatgtgacaagaatattatttctaaaagttccacactacagaaacacactagaacttacttcccacattaaaagacaacctggaggagtggctattacatctcaggccaagcattaatctttccaggattacaacttggctcccaaagttgccaagctattgcttagacaaattatttaatctgtgttataccaaaattatttccaggcccccacaatttgcacctggctgctatacttctatgaagactagaattacctatgagtaagagtccaaaataagctttctaaatcaattcagacctgtctcacatactttttggtttacaattgataaccatgaaggaattctgagtggaggtgccctgacctttgacaaatctcctatctgtacttggtaccagcttgagctatttttattgctcaaaccaataggaaaatttgctgaggcctcagagatccaccccctccagagaatccctgatttcccaaaatttgatcgagatctaaggtttattttgctgtacaactcattttctggagttttacttgcttccaacaatgaaggcaacttttcctgcttccatgatgatggagagcaggcaattcctttctggggtttcagttcacttctaacagggaaggagggaaggagagtttgagttttttcctgcttctaggatggtacagagcagtcttcagcctgggccctattcctaggtaagtaactgaacctgtgttttgtcttgaaattctcctaaatgattaaagttatgattaacaaccaggctgaggcaagagaatggcgtgaacccgggaggtggagcttgcagtgagccgagatcgcgccactgcactccagcctgggcgacagagcgagactctgtctcaaaaaaaataaaaaataaaaaaataaaaaagattaacaaccaactgatcataatttcttcttaccgttagagtgctaagcaatcatataaattgtgcgatcattaattttctgaactgttttttgttttctgtttgtttttattgttgtttccttcttttccccattgggtttgaccagttctatctgacttgatcaaatccaaaggaatgttccaaattatggggacaagacctctgaattggataaatctctgcagaaaaataaataaataaataataaaaatttaaaaagagggagagcagggaaagaaaaataaataaataaataaataaataaataagcagccatcacgaaaataaaggttttcattgggcacggtggctcacgcctgtaatcccagcactttgggaggccaaggcaggcggatcatgatgtcacgaaattgagaccatcttgacaaacacagtgaaactctactaaaaatacatctgtactaaaaatacaaaaaaattagctgggcatagtggctggcacctgtagtcccatttactcaggaggctgaggcagaagaatggtgtgaacccaggaggtggagcttgcagtgagccctgatcacaccactgcattccagcctggacagcagagcaagactccttctcaaaaaaaaaaaaaaaaaaaaaaaaaaagagagagagagaaaataaaggttttgactaccagaggggctttatttatataacaaggccacctttgctagccaaaccaaactaaaaaagcaatggttgtcacctcgtaccccaggctgcagttcagtagctaaggttctgccccttttttcaccatgacaacctgggtttggttcctaaatcaatttctttccagtttgatatttatgttacttttgaactttttttttccagggagctttcttagcaggatcattgctggctttcaccccagctgttacagaacagcttgactgaattcaaaatccagaagctcagagtgtatcctgggaagatggtggaatgagaagcacctggaatctagacaacaactgcacaggcaggatctgtctgatgtaaatatttcagagctctggagcctactgatggcttgcaacttctggaggaaggcccagttggtaaattgtaggtaatttcagtcaatttcagcccttagcacaatagcagctacccaacactacccccaaagcagtcatcttgtgttcctacagtaagttacaagctgctagcccgtttcttagaacctctcatttcctttccatcgtggaaatctatcctcaaggaaacacttctcagtgttccatctgctattctactacccctcagggattgctcaggcccctccctttcctacacatcaagctaggggatttgcccccgcccaggactggcaaattgactttactcatatgcctcgagacaggaaactaaaatacctcttggtctgggtagacactttcactggatgggtaaaggcttttcccacagggtcagagaaggccaccacggtcatttcttcccttttgtcagacatcattcatcagtttagccttcccacctctatacagtgcgatagcggaccggcctttattagtcaaatcacccgagcagtttctcaggctcttggtattcagtgaaaccttcatatcccttacggtcctcaatctttaggaaaggtaaaacggactaatggtcttttaaaaacacacctcaccaagctcagccaccaacttaaaaaggactggacaatacttttaccacttgccttctcagaattcgggcctgtcctcagaatgctacagggtacagcccatttaagctcctgtatagatgttcctttttattaggccccagtctcattccagacaccagaccaacttggactgtgcccccaaaaacttgtcatcactactatcttctgtctagtcatacttctattcaccgttctcaactactcataaatgctctgctcttgtttaaactggcggtttactctgtttctccaagccatcacagcttatatctcctggtgctgtccccagatttgccactcttaactccctcttaaagtaaataaataatctttgatggcagggctatgctgaacccccttgggcactctctaattggatgtcctgggtcctcccaattcttagtcctttaatacctgtttttctccttgtcttattccgttcttttttcaattcatacaaaaccgtatccaggccatcaccaataattctatatgacaaatgctccttctaacaaccccacaatatcaccccttaccacaaaatcttccttcagcttaacctctcccgctctaggttcccacacctcccctaatcccgctcaaagtggccctgagaaacatcgtccattatcactccataccatccccaaaaattttcatcgccccaacacttcaacactattttgttttatttttcttattaatataagaagacaggaatgtcaagcctctgagaccaagctaagccattatatcccctgtgacctgcaagtagacatcaagatggcctgaaataactgaagaatcacaaaagaagtgaaatttaaatggcctgttctgatgacattccacaacaaaagaagtgaaaatggctggtccttgccttaactgatgacattgccttgtgaaattccttctcctggctcatcctggctcagaaagctcccccactgagcaccttgtgaacccatccctgcccgccatagaagagccccctttgactgtaattttcctttatctacctaaatcctataaaatggccccacccctatttcccttccctgactcttttcagactcagcccgcctgcacccaggtgaaataaacagccttgttgctcaaacaaagcctgtttggtggtctcttcacatggacgtgagtgaaacacacaatgggatgcagaggcttatataccgtctcaagttaacagaatgaataaaggctcaaagcatggccaaaaccaggtaccattagagtcagaggtatatccatttattgtgggcaagacaggttatgggagggagagaagaggaggcctggctagcaaaggtgatcttaatatgtaaatgaaaccttacaggcagcagctctcagaaagaataagctctgaaagtttctttcagacctttacagctgtcagactctcagttaatctttcctagatctgggcaaggaaagacttggctgcatcaatgcagattccctacagatgcaaatctccccaacgaaagacaactttgcagggctacttctgcagctggctttctgaacagacatctcaaaatatgtcaaagaaatgtattttggggtaaaatatttttaattccttcacatctacagcctgatgcacctgccgtttcaacgtaccattgttggtggcaattccattctttcctacaattaagccaaaagaacagattctccttgaggctagtctttttctcacagcacacatacaatttctcagaaaaattctgtctcctgtttggttaattacagactttaacctgcccaatctttctctttcttggtctttgaattttggcaaaggagtctcctgatacaggcgggattgattctactgacgagtctcaaaaccgtcagacatttaagagccttaatcttggggtggaggtttgggccacccttgaacattttctttgagactaccggaccaaatcagcctggccaggcctgtcttcaaggcccaggggcaggaccaggtaggtcctcccgacgcttcttgaagcttctcccgcgtgtcggcagccaccctcctcttccgtgtgacctgcagagaagcttcagggggcatttattcaattttctaggagcccacgaggcgcaggtgagcggtgacgctgtggttcccaccgcaccgccgcgctccttggtcctctcgctgtctccggcgggcagtaatgttccaggtgagcttgggctcctaagacaccaggcagggagggaccagtggggaagggcaccggccccttaggtccttcgcagtagggatccgaaaaaggtcttgaagaaatagaaagggagagttggaagtagatcaaagggaaagaaagaaatcctaggagattttctatctgaaggcaccatgaagagacactccctcttctgggccgggtcctcaggtcgctggtgaaccgagttccgatctacgttggcgatcaaaccagttgactttggcttgactcctagtgaagaagccacgctttgtcctcccctgtttagctcttgatcctgaagcacttgattagggctttgaattccagggatgcaaatgagaagtttgtttttaatgcacttccttgaagtaagagtatttgaaagtatttttgcgaagaaaaacatttccttttgcactgaagacattcagatgtgaggaagatcactcagctggggaaagcaaatgctgttgagaatgtctcacaaacacaaattacatgtcagcaggtaggtttgaccctcaggttgggcacattttaagtgcactgttggtggaatttaagatgaatctaggacattcatgattaatatttttagttttttaggaaaatttaatattttaaatttaaatacacattctgaaaattacataaccagcacaagaaaccggctttatgccattttcacaagcacatgaaagatgatactttaaatggcaatgcttcataaatggcaacatttttaaagtactagagaaaaaaattaacctagaattctatgcaaaaataaaatttcaaaactgtgagtgaaataaggacattgaaaaacatacaaaaactaaaagaattcaccaacccacgctacaagaaatcttaagagtcctccaggcagaagcaaaaggatcccagataaaaatctggacctatacaaaaacaaatattggaaatggcatttagaaagcatgtactacacattttcttataatttaaatctttttaaaaatatttgacataataaatgaaggtaatgataatcacaaaacttataatgcataaagtaaaaatacgtaacactaggataaaggccagaaagggaggtataattacacttgaaagcagaatgtgataaattaaagatgtatcccagaaaccctaaagctgccactgaaataagagaagggttatagctaataaagcaacaaaggaaagaaaacggaattaaataaaagctatgtaaacactatgctggaacaactgctctccaggcctccaccctatagaaatacaccagtggccaatgagaagtgtacaagaatgatgactgcagcatcgtttgtaatcataaaataatagaaccaatgtaattttaaagatacataaaaagggttttatttatttaacaaacagacaattgaacaaacaaacaatggaagcaagtcatttgccaaaaggaacacagagggtcatgatgatctactcctccaaggatttcagggttcccagacgcctagttttctgtctagttctggaagatgttattcttggggagcaataggtcctcgagtttggggctctttcaggttctctctccatttccccattctgctacaatagataaacaaacaaaaacaattctcacttccagaagatcccgcctgtacgtctgcacgagcccttcaggaggtctggatgtctggttcacaactcccctgcttcttttccagcttttgctttcccttcccccgctcccgccctaccgccccacgacccgaccaccgcccagctgagccccagaggctccacagcgcagaaggtgcaccggaggtcgtgtcagttgcccgccccgcggggtgccaagaaatcaacgctttgtaaaaagaacttccccgtggaaaaaaatctcttgatttccactctcacctctcttcaaaggactaaaagctaaaggcgacaagggattcattcgacaagtcctagtcgtgcgcccttgtgagtgccagaccctgctccctgccaggggacccacgagcgaccctcaccaccatccctgccctggtggagccccgggcggaacacaggatccgaagatggcagcggaagctccgcagcagcccaacagcgactgggcagggtggatacaggctccttcactgggtgaaggcggcacaaagaaccggaagaaccatcccgggagcccaccgggcgttcagcttcccttgggaccccaggcgtctcgggctgggtcgccgaccggggcgtttctggggtctctccctctggctccagaatctcctaacgcgcaggtgtccaacgtgaccagcgcgattcaccgctctaatatctctggttttccaagaacttgctcagtcgtcctgccaggcgggccctgggaatagaagggacagaggaagtttagtgagtgcgcccttcctatatggcccagtggagttagcagtgcttgtctctgtggtgcaatcggttagcgcgttccgctgttaaccgaaagcttggtggttcgagcccacccagggatgcttattggaacttttaaagcatgcacgtattgtcaatcactacataaatggggaagaattagccactaatttatgactgatccatgtcaagggccagccagctccccgaccagattcttaatcgggtatctcctgaaacggcgggtttacacctgtgtaactcaggaatcctgaaacagagacctaggaacccacttctggtgtgataaaattctaattcagtcgattatacgcttaaatgagtaacttacttgtctccgttttttcatattttagtaataggagtccagtagtatctccaggatgtgcctggatttactgattggtctatcaataatgtgaccagtggaatcattcatcatcatagtgatcctctccatcatttttgaaaacagtatttttcctcagtttgtgcattatttatttaacccttttcaaaatgtttttgttagccaggcatggtggcatgtgcctgtaatcccaggtacttgggattctgaggcaggagaatcatttgaacctgggaggtggaggctgcagtggaggctgcaccagtggaggctgcaccgctacactcccgcctgggcaacagagcgagactccatctcaaaaaaaataaaaataaaaaaataaagtttttgagatgaggtaggtttcattgttttaggattacaaagaatgctgcagccacctttcttgtacacatatctttggtcattgtggaaatgtctacaccgcagatatttctatagtgtagggaagttgatgcactattgctacattatagggtttacatgatgcttctaatttgagtacattccgcaaatgtatctttcacgggagccgtaccaaataatattccagtagcaatatttataggaggaaaaatgtgcagaagtgcaattgagcttcgtgcctctccatggggcccatgttcataaaatggtggcattagcaatcatctgagagtggaggagtttgtggccctctgacatcaaaagctgaagcagaggacatgaaaaccctcactgtacatcctctgtagtctggccagaatcattcctaggtcagtggtctcttatcaggagggaatgctgcttgcttgttttgtcaaaaccacaaaagggagggaaagtttcaggccattggttgataacagtggagaggcaagtctttccaaagggctggtttgttaacccttaggaaaaaaaatcctaattcttaccagatggttccatgaagttccaggcttttggtgtcccaaacaaagaactgtacatgacacacataaagcagcaaagcaaagcaaaagtttattaagcacagtaacactctcagagtggggagagtctgggagatgagatcagtattagtttggtgtactttgggtctttttatgtgtgtttttttcttctcttcacagggatgcctaatctttagccagtgtttgtcttttgattgacaggtgcttagttactttggcccttgtgtgcttgcacgttgcctccatcccataattttaagtacatgcatgatatgtagtccatatgcatgagttttaatgagctgattatcatatgaagtcatgttaagcatactttttctctctaatgcacatgcctgtctctgaggagctgctcctttactggtttggatcttgcaggccatggggtccttgcttgctgttttttgtttttttgttggttttgttttgttttgttttgagacagagtctgtctctgttgcccagtctggagtgcagtggcacaatctcggctacctacaaccttctcctcccgggttcaagtgattctcccacttcagcctcccaagtagttgggaccacatgcgcacaccaccaaccccggctaatttttttgtattttaagtagagatggggttttaccatattggccaggctggtctcaaactcctgacctcaggtggtccacccactttggcctcccaaagtcctgggattacaggtttgagccaccaagcctgatcaaaaaaagattttttaaaattattcttttaggccagtcgaggtggctcatgcctgtaatcccagcactttgggaggccgaggtgggctgatcacgaggtcaggagtttgagactagcctggccaacatggtgaaaccccatctctactaaaaatacaaaaattacccgggcatggtgtctggtgcctgtaatcccagctactcgggatgctgaggcaggagaatcacttgaaaccaaaaggtgaaggttgcagtgagcagagattgcaccattgcagttcagcccgggcaaaagagcaaaactctgtctcaaaaaataaaataaataaaataaaataaaaaataaaataaaataaaataaaaataaaataaaataaataaaataaaataaacaataaaataaaaattattcttttagccgggcgtggtggctcacgcctgtaatgccggcactttgggaggcccaggagggcggatcacgaggtcaagagatagagaccatcctggacaacttggtgaaaccccttctctactaaaaatacaaaaattagccgggcgtggtggcaggcgcatgtaatcccagctactcaggaggctgaggcaggagaatcgctggaatccgggaggcggaggctgcagtgagccgagatgacgccactgtactccagcctggcaaaagagcgagactcgtctgaaacaaacaaacaaaaatattcttttaaacttgtgtcatggccgggcgcggtggctcacgcctgtaatcccagcactttgggaggccgaggcaggcagatcatgaggtcaggagatccagatcatcctggctaacacggtgaaaccccgtctctactaaaaatacaaaaaattagccgggcgtggtggcgggtgcctgtagtcccagctactagggaggctgaggcaggacaatggctaaaccagggaagcagagcttgtagtgagccgagatgtcgccactgcactccagcctgggcgacagagcaagactccgtctcagaaagaaaaaaagaaagaaagaaagaaagaaaaatgaggaagctactgatagtccagtatggtatactgtgacagattgaaaaaaaaagtggttatattttgcagcttctctcatcaagagagtctatttctcctctctttgaatcttggattggctatatgacttgctttgggcaaatgttggtgccttcgcaaacctggcagaagagaggcttgcacatgggaggattacctgcttttttcttcacttgaaatcctgaggccatgatctgaagatcccccaaagctagcctgctagagagatcacatgaagaaaaagatccatgcatcccactttttccaaccaatccacctataccccagatgtgtgaggccatcctagaccatccagccccaaatgaaccagcttggactagaagaatttccaagccaactcacagaatcactaaaaataataaattattgttattctttttttattttttaagagacgagatctcagtctgtagcccaggctggagtgcagtggcatgatctcggctcactgcaacctcggcctcccgggttcatgccattctcctgcctcagcctccctagtagctgggactacaggcacctgccaccacgcctggctaatttttgtatttttagtagagacggggtttcaccgtgttagccaggatcgtctcaaactcctgacctcgtgacctgcccgccttggcctcccaaagtgctgggattacaggtgttagccaccacgcccagccaattattgttattctaagtcaataagcttgggatggtttattatacagcagaagtgtatcaaaagggtgatggtagttgcaggaaataaatatatacctttaattgtatatgcataaacatctttggaatgatacctccaaaatacaaattcccatattgaaagagcacactcagtacccagcatggtggatggaaatatatcatgaagtttcaaactaataggaagaggtagaagattctataggcttttgggaggggagatgggagaagagtttaaggcaaataacaaagaatcagagcggcatccatcttctctatggtgctgatgtgctccagtgtataaccatcaggaacaaacctatagtcaaacctgagtatattggctcattgcaacacaggagacagcaaacactatggggaaattgtggggcaattcttcctttgggaatctcggtatttttatctagaaagtgggagaagtggttgcaagactaaacacataattggtaaagaatcaacagtcaatacaaaagttagccaagtatggttgggcatgcctgtaatcccagctacttgagaggctgagggaagagaatcacttgaacgcaggaggtggaggttgcagtgagctgagatgacgcccctgcactccagcctgggcaacagagactgtctcaaaaaaaaaaaaaaaaaaaaaactggcctggtgcagtggctcacgcctataatcccaacactttgggaagctgagcggggcgggggtggatcacaaggtcaggagttccagaccagcctggccaatatggtgaaacccagtctctactaaaaatacaaaaattagctgggtgtggtggcaggtgcctgtagtctcagctactcggaaggttgaggcaggagaattgcttgaacccaggaggcagaggttgcagtgagctgagattgtgccactgcactccagcctggtgacagagcaagactccatcacaaaaaaataaaaaataaaatcattaaccgtcactattagtagctgggatgtttgatcatattatggtttgaacagtgttctttttatgttcaaatatgattgtgaaatagtatttctttcagtttagtgagagggtaactttgtctgatattggtgttgtgaaatttttcgttttaaccatagaacaccatggcctaggtgtttgtcagaccagctctagctcagagcagaaaaggcttacctttttctttctcagaaatgactatggaaaacagtaaacaacaagggccgggagccatggctcaggcctgtaatcccagcactttgcaaagccaagggaggcggatcacttgaggtcaggagtttgaaactgtagcaggagtcatagacaaaatccctcagacacccgattgtggaatgtaagagcttttttcagctgggaccatcggtagactcacatcctagaaaccgagctccccaaataagtaattcttgtcccttttaagggcccacaactctaaaggggctgtgttgggggggtcatgatcaactgagcaagcaaggggtacgtgactgggggctgcatgtactggtaatcagaatgaaacaggacagaaaagggaatttcataatgcttttttatacaatgtctggaatttatagacagcacaatcggtgaggtcagcggttgaattttaacaaccaggcccgaaatgtggcacccagttgtctgagcgtgattttcacttctgcccattctttcaacctccactttttcagcaaacaagaaattaagtgtaagacaatatgaggagtggtcgctctcaaaaccagcttggccaacatggtgaaaccccatctctactaaaaataaaaaaattagccggacatggtggcaggcacctgtagtcccagctactggggaggctgaggcaggagaatcgcttgaacctgggaggtggagattgaaagtgagccaagatcccaccaccgcactccagcctgggcgacagagcgaggcgagactctgtcacacacaaaaaaagcagtgccttcaaaaatctcagagagaaattatttccacctatctttttgtatctctatctagtaaaatatcaattaattttatgggtataaaagacattttcagacatgcagtgtctcaaaaagtttatttctaaggtaaccactttataggaggttttggaggatatgcatcatcaaaaggaagaagtgagtgaggaatgaacccccttgagatccatgaagcaggggatctaacaagagagaggcgatggaaatcccaagatggtgcagtaaagagagatattatgataacagctgtgggataagcctgaagagcaagtcatccagaatggaacatatagaaatgtgccaggaaaaatttctttctttctttcttttttattttttatttatttttattttttgagaaggagtctcgttcttttgcccaggctggagtgcaatggcgtgatctcggctcactgcaacctctgcctcccgggttcaagtgattctcctgcctcagcttcccaagtagctgggagtacaggcgcccgccaccatgcctgactaatttttatatttttattaaagacggagtttcaccacgctggccaggctggtctcgaactcctgacctcaggtgatccacctgcctgggcctctcaaagtgctgggattacaggcgtgagccaccgtgcccggctgctcttttttatagacgaagaaattgaggtacagaaaatccagtaacgttttaaaagtcacgtcatgaatgaaccaagatttcaacccagaaattgaggcttcactacaagtgaagactggggttttcttgttttcaattattgggagttttggatttccaggaatgtgcaattgtaaaaacccagcttcaagaggtgatgaaataggtgcagtggctctggcgtaagctctgaagccccaggctcaggctctattgaaaaattacttttgctgaaatattcctgtttttaggaacttccatggaacttgagccttcacgcagcatattttggcatctgattcaaagctaatagaggtccggaggattcccaggattaaagtctttaaacagaaactgtgaatcttgcctaagcaaaaggtgccatccctggatgggcttgcaccaccaacctttcagttaacagtcaaacgcgctaaccgattgcgccacagagactctaatggcttgtgtcttaaactcatttgctgataccagaaatggctttttaacctctggctgcagataatctcatatatttgatgcctgtccaatcccgcgcactccagaaacccagaatacgggagacaatgaagccaagagtcgagtctttgggcactttggacgttctacccgggcagagtcagctgggggactccaacggccaaagggccacctgctcctcaccgtctgctcttcactgcttcccccgcctgctcttcaccctctcaaaagtcgctggcccctctacaggtgacaactgcagcttctccggcgaaagccactcgctttcccattcttagccccgctcacaccttgcgctcacagtcatttccgccaggcctgggccagcggacgcgcgcgtgggaaggaccagaacccgtggtgtcctcactgcgtccccctcgggccctcagaggtgggatccacaggaaagggacctggagtttgcacaggctgcagcccttcgcccagagccaccctagcacctagtaggtgcccaataaatgctcagtgaaggaaggcattccaccgcagggttttaggagaaccatgaattcctggatgaacattaagcgtttagtcctactaggaagtctggaatatagagacttgaactgtttctcaaaggcagctgttcttgtatccccagagccggtttagaatccagcaaaggcccctgcccggtgtatcccacctctggagacccgaggatagtgcggtggggagcaccgcgggttctggtctttcccacgctcacgtccactggcccaggcccaaaggaaatggctgtgagagcaagatgtgaagatagttacaaataccagctagggccagtgacagttgcagaaatgaggacttgtaatagttaggagtatttcttcattattttgagatgaatacatttggttatatattaaccaatacttttcttgagaattctcatcttccatcatcctcgctatcatattcattaatagttaacttttagaaatctcaatatttaggttacaggatagcaaatatggaatgtgatctagctaaaaaaggagtgaacatcattcaaagacaaataaaagactttatcctgttggggaaagggttggcatattttcactgaatgagaaaaagtatgattttcctattgtctttatttgaaccttaagtatggctttacaaggaggaaaaaggaggaagaagaagagaaagaagaggatgaggaagaggaggaaaagagaaggaggaggaggaaggtgcacattgatgccactttgagaagaagtggactgtggtggatttgtaatgtatcagttttgccaagctgaatgcacatttcccagatttgccatctttagatagctctaggttagcctgggcaacaggagacacttggaagatagaattcaagtggctgttacacgcttttgtatactgggaagggcgttgttacagctcaggcatgatcttcatcttccctgacccttggactggtgggtgttttgcttcttgatctaacattaaggttagaagttgcaggatcccagctgggttttgttacatccaatctggtttaagttcccatattattaggaaagctttagggtgcttcaggaaaacgctttttaaaaaatcagatttggaaaatatcaaatggaattacaggcaataagcataacccagtggaaacatgaatcaaaccctctagagcagggttgtctaaattttgggttccttgggccacactgggaaaaaaaaaaaaagacatttgtcttgggcccagcataatatacactaactgcaactgaaccgtgcgtgtaaagcttgtaaacaaaatctgtctgtaaagtctgtaaacaggccaggcgcggtggctcaggcctgtaatcccaacattttgggtggccgaggcgggcggataacttgaggtcaggagtttaagaccagcctggccaacatggtaaaaccctgtctctaccaaaaattcaaaaaattagccgggcctaattttttagtggcctgcgcttgtaatctcagttacttaggagatcgagtattctctggctgaggcaggagaatagcttgaaggcaggaggcagaggttgcagtaagccgggatcccgccatgcactccagtggactgtttgctgttaataaatgtttacaatgggctcccgtagggaaaagaaaagcttagttttatttctatagaacaaaaaaaaaagttaagagattagtagagacgggtccaccatatttgaccacactgacatcaaactccagagctcgagcggtattaacataaagttatcaatgcatctcacagactactgagattacaagcgtgagaaccaaccactacctggcaaaatctttactttgaaagtaagttacagatgggaacaaagacctgtttattagtttatactaacgccttgtatatgcttccacagcaaacaaaatccacttttaaaacgacaacaacccagggaaaaacacagacacagttccccactgccacaaattatgtaatcaagattcccacattcggggaaatcacaggggtcagcacatccacagtaaaactgctaagccttgctctggaaaaaccaccttcgtgatcataacatttcttctgccagataaacataagtataagctcacgcccctccgccccgccgcagcctcatatgcctcaccctttacacgcaaggtcacttgcgtcacgcgcatccaggagccatcctagccctaacacacagctgcgactctccggtccgaccagaggtcccagacttactcccacggcacgggaactctttcgtggcgaagcagcaggtggcgaagcagcagcccctgcgctgcctcatctacatagaaatcgccctctccgtgatgtcaccgacaacgccttctggatccccgtctgctcttccgcctcacccaacgcccctcagcggagcaaccagctgtcggagccggcgggagaagtgacttatgcctgtcccttctttctctcctgtccccgcccctcgtctcccgcaatgaagcgagtatttaatctgtgtcctgtggaagtcccatttggcggccagctggaagcccgtgcacccttcttcaaataatggctttcaatgagcagactagaacgtttaggattacaaaggaaaccgattcctttcaaacttggttatctttgtgatgtggcactgtgtgcatatcttcgttaaaacgcattgaaggccactgcactccaccctgggcgacaggaggtgactgtgtctcgaaaaaaccaaaaacactcccccctcaccccaaagcattagacgtcaaggctggcagggatgtctgttctcttgaaagttcaatatcaaaatacttggaaattaaactaaaatagtagaagcaagaacaaaaattaagttgaagataatatcaagaatatttcccacaaaccaaaataagaatgtaaaaacaggagagaaaagttcaggaagatagacgtccaaggtccatatgattagcatgcgtatcagaaagaggatagaaaaaaatcagtacaataattcaaaacactttccataccaatggattgaaactacagtgaatttaaagtattgaattgatattgaactttcaagagaacagacttccctgccagccttgatgtctaatgctttggggtgaggggggagtgtttttggtttttttgagacacagtcacctcttgtcgcccagggtggagtgcagtggccttcaatgcgttttaacgaagatatgcacacagtgccacatcacaaagataaccaggtttgaaaggaatcggtttcctttgcaatcctaaatgttctagtctgctcattgaaagccattatttgaaggagggtgcacgggcttccagctggctgccaaaggggacctccacaggacacagattaagtacccgcttcattgcgggagatgaggggcggggacaggagggaaagaagagagaggcataagtcacttccccgctggctctggcagaggtttggtcccctgagtgctcctttcttgtaagcagttcttgtttcatattttcactatctctgacactattaactgtacaattttttttcttctgtacacaaaaaaagtttgtttcaatagtgaagtatgagtcagggtggtggctcatgcctataatcccagcactttgggaggccaaggcgggcagttcacctgaggttaggagttcaagatcagcctggccaacatggtgaaaccctgtctctactaaaaatacaaaaattagccaggtgtggtggtgggcacctgtaatcccagctatttgggaggctgaggcagcagaattgcttgaacgcaggaggcggtggttgcagtgagccgagattgcaccactgcactccagcctgggcaacagagcaagactccatctcaaaaaaaaaaaaaaaaaaaaagtgatgtatcttctacagtatactcttccaacttatcagattctgtcattgacatacgatgttgcatcaatacttgtgtaaggggtttaacactactactatatataatatatgtaatatattttatatatatatgtatatatatatataacactaaggtttattaaaacaactctcagtaaacagatgcccctgatgttccaacaaaataacctactattattagaaaccaaataaactcctcctcctatgaggaagaaagtaaacaacttctggcttggcgcggtggctcacgcctgtaatcccagcactttgggaggctgaagcgggtgctcatgatcacctgagtttaggagttcaagaccagcctggccaacatggtgaaaccccgtctctattaaaaatacaaaaattacagcgcgcctataatcccagctactcgggaggctgaggcaggagaatcacttgaacctggggggcagaggttgcagtgagccgagatcaccccactgcactgcagcctgggcaacagagcaaaactccgtctaaaaaaaaaaaaagtaaacaattctggaacagtttgaaaaagcaatttaagtgaaaatgaaaccaaaaagggtaaaaagaaaaaggagggaattgtaggaaataacctatatgtgattatctattttcaattctaagtggcttggtataggtttaggcaggctacctggaaagaaagaaataaagaagcagaatgtactgagccaccccctccaccttccttctttccctttcacccagtggccaggcatctatcggtgggggctccctcatctaccccttccccactccacaaagaaatttagtttaagctagcttgcaacatagataattgtaccctttcttatcagctaagtgcagccactagagctgtaagtcaaatgtttgaaaaatcctgagagtcataatgcatcgtgtgctgcaataaaatgcagcagaaagaccctaaagaatgtacttgaagaacaatcaataggtgatgtctaggaagattgtggaaggctagtactcagcctatgaggaactgagggagggacctgtgcactagggcgtaaattgcttgttgaaactgtgctgggtgtgcctgcatgccagacacccgatcttgcaagaccgtcattaaaagtctcactttcgctgttctctgggtctctgagttcattgtttgggtttagatgggtgaatttgtttctcacaaatttgattggattgaaggatgagagtattgatcctgggcgtatctgtgagggtgttgccaaaggagattaacatttgagtcaatgggctggggaaagcagacccaccctaaatctggtgggcacaatataatccactgcccatgaatataaagcaggcagaaaaacatgaaaaggcaagactggcctatcctgccagcctacatctttctcctgtgctggatgcttcctgccctggaacatcagactccaagttcttcagttttgagacttgaactgactttcctgctccttaagcttgcaggcagcctattgcgggacattgtgattgtgtaagttaatacttaataaactcctggctgggtgtgatggttcacacctgtaatcccagctctcagagatgcagaggcgggaggatagcttgagcccaggagttggagacctgcctgggcaatatagcaagaccctgttttccacaaaaagtaagaaaaaaaagtaagtgtaatacttaataaactcctttgtatatctatcctattaattctgtctctctagagaaccctgactaatacagagtcacataaaaatatgagcctcaggccaggcacagtgggtcacgcctgtaatcccagcactttgggaggccaaagcgggtggatcctgatcacctgaggttaggagttcgagaccagcctgaccaacatggagaaaccccgtctctactaaaaatacacaattaaccaggtatggtggcacatgcctgtaatcccagctactccgaagactgaggcaggagaatcacttgaacctggcaggcagaggttgcggtgagctgagatcacgccattgcactccagcctgggcaacaaaagcaaaactctgtctcaaaaaaaaaaaaaaagcctcaaagaaggccgtatggttgaagtttatatgcagcacataaaggactaactaggcttggagttcttagggggtggtggccacaggttatgggaggttgaggggaggaaagacatggtgagcaaaggctgtgttgtgatgcagatgtgatgcagatgaagtctctcaagaagcagccctccaccagatgtggtggctcatgcctgtaatcccagcactttgggaggctgaggtgggcagattatttgaggtcaggagttcaagaccagcctggccaacatggcaaaccccatctctactaaaaatacaggccgggctcggtggctcatgcctgtaatcccagcactttgggaggccaaggcaggtggatcatgaggtcaagagatcaagaccatcctggctaacacagtgaaaccccgtctctactaaaaatacaaaaaaattagccaggcgtggtggcgggcacctgtagtcccagctactagggaggctgaggcaggagaatggcatgaacctgggaggcagagtttgcagtgagctgagatggcaccactgcactccagcctgggcgaaagagcaagactctgtctaaaataaataaataaataaataagtaataaattaattaattaacctggtgtggtggtgggcacctgtaatcccagctgctcgggaggctgaggcatgagaatggcttgaacctgggaggcagaggttgcagtgagccaagattgcaccactgcacactccagcctgggtgtcagagtaagaccccgtttcaaaaaaaaaaagtttcctgtcagacctttaaaagcatgagatcttttgtttccttttcctgtgagttaatcttacctggatccagataaagcagataagaaggtctcagagaaagccatttgcagttgatgtttacttcctctacacatgctaatctccctgacaaaaggacagcttttcataggtatttctgtgactgtgttgcctattgcactgcctacatgacttacctggacccctacccagatgttgttggccattgcagtgcctatgtgacatggctgaattcttactcacctttaactctgcttatttttaagaaacaggatgtctgtggtcagaagtttcttcttgggactaaaccagctgaagctggtgaaatccatgatggcagcttacgcaacctctgaaaaacatctagctttattataatccaatttccatgctaaatagcactcccatcagtgcatgacagttgacaatcactgtgacaatgaacggaagagaccaagaaaggacagaaatgaggtgactccttgattctaggaaaatctccatcccttactaagaaaagcatgaatattcctcaccttgctcattcccttcattaaagatcctctatatttgtaacttcctggttctcagtagctgagaaggtgatttgcaagctatactacttctccaattccatgctatgctcctacttctccaatgccattgaatagagcctgcactgcttgacgctcactcttggtttcatacattggctttgcaataataaacaggaaagagtccctttttggggtgagacccctcagtaacatctgcagcccctctaaatagccatctcaaattataccaaaggagtgtattttggggtggcatattttgggcttcccacatggctaagccaacatatagcattcttgctgaacgcagggtgatcagacatcacctagcagatggtgaaggatgaggagccctattagatattatgagtgatcagctattgaagatggggaattctggctaaattgactgagaaggattcttgctgagattgaacaatgcagagaggaacacagaagctcaatagttgaggcctagtgagaagaggactcagaagagcctgattagtttggccaaggagatgtcaacctgaaataaatgaaaggttcagaattcagcgttaaaatgtttattcattctgcttgtgggaactaatggtaaaaattaaaaaagagtttattcaaacaaaaatctgggaatagccaatcagggcacacagactccagagaaatggggtcagtgctgcaaagtcaaaagtgaagttcttgcttacatagaaagaaaaaaaattaataggatcacaacattttctatataaggctgctttaagagttacaacaaattaattagttgcagaatttttttttttttttttgttattgttgttgttctgagatggagtctcactctgttgctaaggctggagtgcaatggcatgatcttggctcactgcaacctctgcctcttggtttcaagtgattctcctgtctcaacctcctgaatatctgggattacaggtgcccaccaccatgcccaggtaattttttgtatttttactagagatgggatttcaccatgtgaaccaggctggtctcaaactcctgacctcaagtgatccacccacctcagcctcccaaagtgctgggattacaggcatgagccccactgtgcccaacctttttctctttccatactacttgttttctttctttatagctggctcacatttcctttccaatttaaaggagtgtatttaacattgcatcttaagacaatgcaatagccatgaagtctttatgagagcaaggtaagaaggaagttaatctataatgaaagtcagcagtgcagagggaagcaatcttccctggcacccttcaataatttgtataacatgttagaaaacaatgcgtgtggctgggtgcagtggctcatgcctgtaatcccagcactttgggaggctgaggcaggtggatcatgaggtcaggagatggagaccatcctggctaacatggtgaaaccccatctctactaaaatacaaaaaattacctgggcgtgatggtgtgcgcctatagtcccagctactcgggaggctgaggcaggagaatggcatgaacccaggaggccaaggttgcagtgagccgagatcatgccactgcactccagcctggcccacagagcaagactccatctcaaaaaaaaacaaacaaacaaacaaaaaaaaaaccaacaatgtatgtaaggaagaaggccaatctataatcagagaaacaaaggttacaactgcctagtttacaggtgcctctcatgtgacttaggctccatactcacattttcttcttttttttttttttgagacagagttttactcttgttgcccaggctggagtgcaatggtgcaatctcagctcactgcaacctctgcctcccaggttcaagtgattctcctgcctcagcctcccaagtagctgggattacaggcatgcgccaccacacctggttaattttgtatttttagtagggatgggctttttccatgttagtcaggctggtctcgaactcctgatctcaggtgatctgcctgcctagggcctcccaaagtactgggattacaggtgtgagccatggtgcctggcccatactcacatttttttaaggctcacagtaatttggaattccaacaacttacattttaaattacttattttcacagaaagaatctttgtcagttgtaactcgcttatttctccaaagaccatagtcctgtccagtgatcctccccaagacaatagctctctctagtaactatagctttcctttcccatttcaatttccactccaattgactgaattgtgaacaccaactcccacacttaaatgttgaagccctaacccccagtgtgatggtttatgcagctggggcctttgagaggtaatcaggtttaaaagaggttatgagagtggggtcctcatgctgagattaatgccattataagaagagacactagaaagcttgctcatccgccttccccatggtgcacaaagaaatggtcacatgggcacacagtgaaactacagccacttacaggccgtaggaagagatcttagaaagaaatccgctttgctagcacctttatcttggacttcccaacttctagaagtgtgagaaacacatttctatagtttaagccacttggtatatggtattttgttatggcaacctgaacagacttatacaacaattaagtcctagaggcaatacaacttctctgctgattccagattctgagcgcctctcagtcctttgttgggttattttgatcctgtccatatatttagaaatattctcttcataaaactctctgtaggctgggtgcagtggctcatgcctgcaatcccagcactttgggaggccgaggcgggcagatcatgaggtcaagagatcgagaccatcctggtcaacacagtgaaaccccgtctctactaaaaatacaaaaaattagccaggtgtggtggcgggtgcctgtagtcccagctactccagaggctgaggcaggagaatggcgtgaacccaggagtcggagcttgcagtgagccgagatcatgccactgcactccagcctgggggacagagcgagactccatctcaaaaaagaaaaaaacctctctttaaatcacacattcgagtgtgccctttgtttctcatcaaagccaagactgatttgagatgatttcttaaggtcaggttaatgtcctaatccagttgtgctgctataacaaaataccacagagtgagtaacttataaacaacaaaaatttattgctcacagttatggaggatggtcagtctaagatcaagttgccagcaggttcagtgtctagtgaaggcccattcctctgtcatccaggctgaagtgcagtgttgcaagcttgggtcactgcaaccttcacctcccaggctcaagtaatcctcccacctcagcctcctgagtagctgggccacaggtgctcaccaccatgcctggctaattttttttttttttttttttttttttggtagaaatggggtttcaccatgtttcccaggctggtctcaaactcttggactcaggcaatctgtcagcctcctaaaggagtgctgggattacaggcatgagccaccgtgcccaccccccaaattctactaatatatgtgcataattaaatagttaccagccatcattttctgatactttggcaattggttgaaagagtttatctaaagacctggaatccatagaaggcagtctctgtgttaaggggttgttcttattatgcagatgaagcctccaggtagcaggcttcagagagaattgattgtaaatgtttcttatcagacttaaaaaggtgcctagattagggaaaagacctggaaagggattccctgtagcatgtagactttccccacaagagacaactttgtagggacatttcaaaatatgataacaaatatattttagggtaaaatatttttatttctttcagggcctgctatctgtcatgtaatgctacactagagtcaggctggaatttggtgtcttattgctacaaaaagtcttaagatctctgttgtaatgccagttgtgcctggtcggatgtgctggtcagttgtgcctgaattccaaaggaaggagggtataatgaggcctatctgacccctacttcccatcatggtctgaaccagtttttcaggttaactttggaatgaccctggctgagaggaggggtgcattcaaatagttgaggggcttggaattttatttgtggtttacactatagaaagtatttttccagtattacctggacaatgtgtctccctgtcagtatccagggaatggcacctggatcaagcatttagtgttcagttgctacactctcacctaatccctcattttcaatattttgccatgttttccagtgacccaactggccaccatgtcacagactttatggtctccaagggagacccctccgttttatgttttgtgatttgagcaacagactggaatctacttgaaatttgcaaatggtctttgacttgggctttccaattttgctctacttcacagtgttttctgggttatatacaagggagatgatccagtcatttgttaagcgcctcaaataagacatgccctagatgtttttttgtttgtttgtttgttttgggatgggacatggaatttacacctaaaataatcagcgtctgaaaggacgtcccctctctggatatggaaaaggaagaactgcaggagttgtatgcagctgccttgcaatcccatgggaaacaatgctagctcacaggaaggcaaaagctgactgttgaaaagaaaccaagtcctcgaagacattgttaggccccaaaccaatcaacccagaaacccatttaccactgaatctagagttaaataagcaagaaaatccccttttatttaatccagtctgagttgggtattctgtcattagcaaatgaaggcatcctgacatgtgggaatatcaagacacacaagctcttgtgcagttttccatgcatggggacagtgccctggcattccagaaatcctggcttacttatcaccactctctaatcaactgcaaataacattttaaaactaagtgcaaagagaatgatcaggaatatcataaaatctgcatttatttaaaaaaaaaaaaggagcttacagtgaagtagtctcaagcaattgctttcttttttttttcttttttttcttttattattatactttaagttttagggtacatgtgcacattgtgcaggttagttacatatgtatacatgtgccatgctggtgcgttgcacccactaactcgtcatctagcattaggtatatctcccaatgctatccctccctcctccccccaacccacaacagtcctcagagtgtgatgttccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggggtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacttcgcaaaagaagacatttatgcagccaaaaaacacatgaaaaaatgctcatcatcactggccatcagagaaatgcaaatcataaccacaatgagataccatctcacaccggttggaatggcaatcattaaaaagtcaggaaacaacaggttctggagaggatgtggagaaataggaacacttttacactgttggtgggactgtaaactagttcaaccattgtggaagtcagtgtggcgattcctcagggatctagaactagaaataccatttgagccagccatcccattactgggtatatacccaaaggactataaagcaactgctttctaagtgggatggctgaagcaagagaccttaaatcacttgactgtcttcacaaaacagaactgaagcagaaccagaagtcccctgatagcctttcagggacaccacctacaaatacaccgtaatccctcatactccacacgccacttcagggaaagggacatgaggcaggaatacaaatatataccatctgtgacacttcctaagctcctggcttcagagtagccatcctgataattattttttaaagtccacattataaatgtgcaagttaagtgagttatggaaatcattccagatactggttcaccagtaacatcagtttagccctaaatattgtcataagttctctgataggctcatgtgatttaagctggtgctctgtcaagactagacttaggcgttttatcctttttatgacattatgtatgttgaagagaatatatgaatatatataaaaccttcattatcacattattctcaatccagcattttctcagcccctgattttcatgttagttcagcattcttacatctttacagattttcatctaagactacatttctattgttttatataatcagcccccctaagatcaacatgtccacattttttggcaaagacaaagcctactgatttcaggatcattattttcctttttcaaaagcacaaacccaaactgagaaataaatcaagagaaattctccttttttctatgctaatttagaagtagagtctttatttcttttcaaacccaaagagaatcagacatacaatatgaatttatctactttcgcttgctcagactgagaggaaagattaatattttcaggctgttagtcaaaactgttcattcaaatattatttaataaaatccaagaaccagctaaaaagtcgcttaagctaagaaaccttcaccagcctcatgggaaattgtgtacagttttccactagaatagcctataaatgcttactgaaaatgtctaagttcatatcttggtaactaacattttaattcaatctgcagaataatatatgcttctttagtgctaagatatgaatattagaggcattctttcttaaaatttctatttagttatactttcacaaataactatataatattaaaattctgcatgtggcataaaacatattttaatggagaaggtaatgtgtagggagtttatttctgtttgctattagaacttgtgtttattcttggttaaaaaaactgcagattacaacatagaaaaaaacaaaagtatgttgtatatctcttacagtagaagataaagagtagttctaaatttagaaaggaaaaataaatatacacagtgaaaatatgtgtcagtgagatgttaatcaaagatcaactattgctgagaccagcaatattaaatccctgcacaattactcatattataatgagaattttaaaaagaaaatatgaacacataacataatgaaggcagaagtcactctcatccttcatctttgtattcccaattcaggaagctggtatagtatcttcattataattactattcaacaaacatttgtaaaatgaatgaataaggaatgaatgatgagaaaaatgataaacatctccctctgtctcctgggagttaactgcactactttcttttaaatttaattaatcctcaatgtccttgtaaaatagccaaagggaaaatgtatttacattactctaaatattgatgcaatctacaaaaagtgttaaacaacttcctcaaagtaaataaaatgttcacaatccagctaggataaaaggatttaaatcatttcctaggtagagggctttcaattagagcccctgctgcattaaccatgggaactcatctcactctcttcatgatggagccctgagtgttgctgctaatctgtactctaccattctaatgcttttaaggttccttttcagcccttcctcctcgtaatccacaaatactgagaccaaggcattttttgggtcagtcctaatttcaagcattctatcctgccctccccaaatgaactcacacttattagaccatatgttcctatattagttcaggaagggggaaaaaatgttaatcacacttgtatataagagatcatagaaaaacagtttactaacctgtgaaaataccattcattctctgtttacctctggtccacagctaagcaatcagcaggatataaatgtaccctatgttcactattcagtattcataagtatactacttatgaattggaaatctgacacaacatttacatgacctaattttgaaaatttaaaatagtgtaaggcccctaggcttaattttacaggggaaagattaaagggacacaagcaaacatatattctctctctgtgctgtgggacactggtaattttttgacttaaaatatttgatacttaaaatgccaaacttctacatttctgcagtaacaaggcagttatcatattgaataccatttctttctctccagtaagtagagttaatattagcacatgaactgaaaatattaagtgattataaaaacgtccaaataaattcattaaaatttagcttggcaaaatgttagtttcatgttcttggtagaagtccttttatatttatattcaaatgaaatgaacaatttacaagcaaaggaaatggcatcaaatatttcacaccctgcctcccaaggtgtattgattcatgctttttgctcagatctaggtttctccactcaggaaaagaggagaatgtacccatacttgggaaaacaagtttccgatggcacagctttgatcaaacagcaaaattctatccatctatgtattgccatctgacagtatgacaaatggtcccatgtgcgatattcacactgcattgcagtcaaacctgtaagtcaaaggatatgaaataatagtaactatacattaagcacagaagaaaatgaaacaaacaaaaaggttttaaaccaaccaaaaatatgtcttattttggatgttctatatgttcttacattctctcaggtcttttgtgtcattatgaacacaattctaacaagcttgattattttatttccattcacatattacaggcaacaagctgaaaaagtagaacggggtgtagagagacaggacaaagtacagattagggcttgaagtgcccctgaccagtcgacagcaaccacatggaataatgactcatgtgcattaatgatcacactaaatgatatttgtttttttacctagtccttcaactgacagcttaaagaacttcaggttgttctgattcttgagcctcctctacagcttcagagaggactttcattttattttggatcaaatgctccacaactagttgaaactggaattaaattttatatgaagttcctagatgatttaaagctgtaagaagaagaataatgaatcataagaaaacttgctgctacagatatcaaaaaggaatgttaccatccctcatgctaatccttttcattttaaataaacaggatctaaaaaaaataatgctgggaagtcctaaccacatcaagaatgcctcagatcagtgacccagggaaccttccagaatggatgaaatagacccaaagctgaattcacctaattttagggccaaaaacccaaaaaacaaaacaagaccaaaaaaatcttcagatactgggagaacaaatctcaattgctcaattgtatcttatgaaaacaatttttcaaaataaaacaagagatatttaagattcattaagttcttgtcatttcaaattttaagaaaaatattttctaatggaattacatatatttatatgattcttctagttatatccatggtaataaatactcttttcagttggaaataaaacccatttgtgctatattattagggaaaatatctacataaattagtttttaatttaactaaagtctatcttttgaattcataagcataaaattttaaccacttgcaaaatttataacacacttaaggtagtcagatgccttgtcaagtagtttaacaaaagtgattttcacctgtttgttttaataacagtgcatcgattttatgaaaatcaggcatgccctcgggtcctaacaaagtatacgaagctgaatggatctatgccaaatatgccagattttactttctgagtctgattttatacttctgtcctctttcttaccacatggcttccagtatcacttacagactaacccttcaaaaggagaaggctaagttactaacatttggaaggcttatgaaagtgaagcatagttatgagccagcaatgtttttatttagggaatgtgtgcaaaccatacacttaagcaagctctggggaatgagagttggggggaatcaactcttttatttgctaattggtatttcctttaaaagatagagttcttccagattttaactgtgttaatagttactctagaaaaattggagatttgtgtgcatatattttatgttgtaaacagacacatacccagagacactgagagagacagacagacagtaaacagaggagcactaaccacaaacggtttacaaatgacctctgtgctcattcacctgtctgttccccaccttgccttttatagcaactatagcaacagccatgagagtcattgtggaaagaaataaaataaaattaaaaaatcctggaagcttgtaaagaatgtgagcaaaggggaggaagttgtgaaaaaaatgaataaagggcaccgatccagagtattgaagaaggcagagtggagagcctagtaatgagtatctggtaccccagtatcctctcccacagaatctgtacagctctccgtttatgacagtttaaacttaatttaaattatcaaacagacactttcctcaaacatataaatgatgaggcagttcattcaggctgtatgtataaagttgttccagccacctttttctaatggcttctctatatcttttacatggagacaatgagagatttgcttaggacaatttgactgtaatttagaagtaggaaatgggaagtatttgtatcttctttgcctaactcacattagttactcaagtaagcatttcttccgttattgcattttcctgattacaagttttatgttttctctaaaacacatatcaaaagaaatgtcctaagcactatgcagggggaagccatgacatttatccaccactgtcagcaaaaacatgaacttagccctcaacagaatatttcacttcattctagtgtcacctctgcgtcacctgcactggagtcaccacttgcctgttgggtaagaccaggatgcaccgctgaaataaaaaggggtcagacaatacaagaaaagccagtagaaattgccaaatgtatcagaatacacacaggctttctaaggatatggcccaagaggaaggctctagagcccaccctgaaacaggatttttgacttcacagataaattatttaattttcaataacacaattcaattaaagaaagggaaatacaaggctaaacaaataagaaatgaagacaaaaacccaacctttcaaatctaaagaaaataatctgttttaaagacacagatgaagatcaggaacccaaaacagaagaaaggaaaggcaattaacgctggcatctgataacaacgaaaagtatggagtctggagaatcgctagactctaaaaattataaaggtttagacttggactttgtacactgaagaaaagaaaactgcatgcatttatactgaccaatgtacactattgctgctttttaacttttgtgtatatgtagggtagatttttttttaagtgaaagcaagcttattaagaaagtaaaagaataaaaaggtggcttctccataggcagaaaactagcgtagtttttttattagaaattgttattcaataatagtacatgttacaaataaataccattttaaactgaaaaaattgtagactttcaaatcagttagggtggtcaccctaaaaaagggcattttttccccttagtctccttgttcatgttgctcacaacaagaaatgggctaatgctatgaataataataacaaacactgccttctgtcaggccctgtgctgaataccgtctgcatatgtataggaaagggttaactcagcaggtcttgtttgcccagactctgtacatttccaagaaaggtctgcctttaggactggtccttggccagctcctggagaatgagctctcagcttttagaaaattctatctgctaagaatagttttgcatgtctcaggtcttgggccacaaaatatcagtttaatcagatggtttatgttaacaagtatgatttatggcaaacatagatctctaatctccatttctctctcatatatctatatttatctatccatatatatgtacctatatatatcaaatatgaagatatgtttatagcaattgcatataaatagagagatagtatgtagtaggaagagagacatagatattattcttcattttagaatgttatcttggtatgtttaaaaggaaaaacttaagatgtgttgcaattgcagtatgagtttcaggtatgtacatgttatgtgtgtgtgtgagagacacacacaaacacatttcaaacatgttttatgtttaagctcaatattcaaacacagaaatataacatctattcttaatatgttttatgtaagtacagcagcagcattattaaatactgtatttctatggtgattgaaaattagtaggcagagaatttttgtaatggttcttaataatttttgtaatagtaaatgattactttttgtttagtatagttttataatctatacatgaataaagtggatatttctattcatatagaaatgtgatttactctcatgtacttatctacatgctaaaaccataagttatcaattttagttctgtgccaaggcacttttactgaataaaaataatcagctaattttatattttcctgattcaaatttatatgcccgtgtaatgttccggggtttttttttttaatttctgtaaatcagaatattcagatgttgaaaaagtctttgccttcagatttaaaagatacctttgaaatgtagcatatcccaaaatgcaacccagaggctggcaatgtcaacatttttctgttttaaaaaacctcttatgaaaactattgccatactaaattttttacttgctgatgacttacagctggaaaggattctgtacatataagacatcaaatattgaggatactggaacttttaaattaatggcaaagaaagtcaacaaaggaagttcatatgaaatcaaactagtaatatgattacaaaaaaaaaagtttaaaatttttcttggccccagtcttatcatttctgagccaaatacaattctatcgaaatcacctgaaactgaaatcaccattctaggctggttttcccataaagatggactgctccaaaaagaggaatcaagaaagaatttggctcacagtgaattattcactttgtcttagttaagtaaaaataaaatctgactgttaactacagaaatcatttcaaattctgtggtgataataaagtaatgaccacttttcagctggagggactaacttcttttttttttttgctgcatatatagctgtggtacattttaatgtgaaatgatgactgcatcagcttatatccatggagcagattttagcattcagcttgggtctcccagtcaatatctacgagtctcttcttaaggagatcgatgacacagatacatacagactaacaaatgtgataccaataatcaagaattcactcagttaagattttgcccactgatttccacacaagaaacctagaatttactagattcttgtgcctgtgaggctccactcatttccctgaatcacaaaagctacagagtatttagatagaaatatacctactcttaacatgaaccattttaaatatatgtattactgtgtccacaggagtacactttaaagcagggacttcactcttcaatctctccaatcacgtgttacctaaagtggcatgtggttccctaaagcttaataactgacattgccttaaaaaaggggtttgcttcccgactaatgtggaaaaagtctgaaaaatgattttaaatctttcactaaatttctcatttggtcacgtggaggaaaatgatttcaccaaatagatactctcattaattttttaatgtaatttatcaaagaaatgaaatatttagataaattccagatttcccccaccatgagcttctccgaaagtatactccatcacagactgctcactaagaagctctactgcagtcaaagtgaccgaatttaaggggacataatgactacttctgctacacagaaacattatccatctctaacacttccctatgagatggaagacggacttctaatcaggtaccagagagggctctgccaacttcagggctttgatgaataagaatggttgagagcgctcatcataaatgaattcagtataactgagtgagaaagtgagagaaccagagaaataaatcctcatgtagaaaatttaggggtatgaaatgccaaatgccagttaaccaaagctttctttgtcataaagcaacttctataaaaattgctgaaaataaattcttcatggctcaatgtgaatcagtaatttccatctctattacactgttgtttacccaaaaactatttttaatgactaagactcagagtttgccagagtgttttccacaaaacaactgttttgagatactccagatctgtaatcaagtaagtctgaaaaaccccaaatacctcactcacctcttggatatgcataaagcacactaatatataacgttctaaaaagccaatcattaaaaccgttttatattgtttaagcatttcctagacatatttggctacaaatctaacatctaattaaacagtttgggaaatgccatcacataatgtaggaatattactagtcatttaagaaactagaaaatatttactatattctaggcagttggctagcagttggagttctagtctctaaacaaaatactgacttatttctgtgacttttttcttttaagcagctctgtgcttcacaatttttttttcctggtttgttttccacttttgtctgtactttattccttcacagatgtgaaaggctaacaaatgtaaactagttatatgaatcagcctctgcctcagttctacacttcaaatacagtatatactctatcaacaattcttggataataacaacctgtacttgttttacaaacaataaaacaggccgggcaccgtggctggctcacgcccataatcccaacactttgggagaccgaggtgggccgatcacctgaggccaatatggtgaattctcgtctcgactaaaaatacaaaataattagctggccgtggtggtgtgtgcctgtaatcccagttacttgagagactgagacaagagaatcgcttgaacccagggggcagaggttgcagtgagccaagatctcaccaactgcactccagcctgggcaacaagagcgaaaactccatcttaaaaataaaataaataataaaacaatgatgaaaacacaactaactacagcacttcagagttagttgacaaatccaccttttcaatctacatttcaaaatgttcagaaagacaccatcctaggggaagtcaaccagcagcaacctctctgctaatttttgtacacagaaacttgacctgactgcacaaaagtttcaatagatgtctccctctaaaattaatattgaatgatttgtcatcttccatttaataccaaaagggtatcagccacaaactgaaatatcactcatatgcaaataaataacattcaagacttttgtcgttgtggttattaatcttgtaatggatggacataaatctattcacattctcatcctatcctcaaatttcactattctctcctctcattcttactttgttctactcatattctcactctatcctcctatgcataaaatattatgtatcctaatgaacagagataccattcgtgggcaaggaaaaaacacaatgaactgctctttataataaaaaccatgatcttgacacagatgttatcaatcaataaactttacacagctttacactaaattaatacaaactgctgatgagtgggtggggggtggtcactaagcaaacagaagcatgtaggtgttaggaagcatgagaaacatatatcagtgggtagggaaggcagctctcaaaggccaagaatataagttttaggtctatatggaaaaagctgtggtcacattcgaaggcttctgaacagaagaatgattaatttcatgcttaaagagttcaggtgtaaataaactggatgggtaagaaactcaaaatcaagaattttaagacactgggttaaggtgattgagctaagtcaaagccaacagggcatgggctaaatattgacatgggatgggatgaagaggccaacaatgtttcaaagcagaggttgccggagcttcaggaaccagaagaggaagacttgaggtgaaatctgaaacagcaatccccatacctgtctcaaaagatgtgatactgactaggaaaaggctggagagagaagcttcttttaaagaggtaataagggattgttttgatgtgctgggttgaggtgaaaatgacaaatattcaggtggaagtgtccagcattcaagtaggataacttggaacagaaagcccaaattatgtcatggtgaaatgaggataatgtcttattaataaaaacacgtcttactagtctttcctggggaacatgaaagatagaatttcagaaatttagagaatgaaaaaggaaagattacaaggcaataagttgattaaaatagactaaactaatcagtggcagctatcttaaagcaagatatatcttctacagcacgatctacccaaatgcaaatctgggcagagaaatacaaaatatttttaggactgacaaaatttcagctatatgtctttttaaaaatgctgcagagagaaatttagatggattggacaaatatttgcataaggattccacagccaacgtacacaattttccaactactatggttagcactgggctcaggcactacctttgccaaccagcagattttcagtattgcccctggcagacatcccattagcaatctctccccattcccaaacattcccaactattctagtcatgccaattcaaccaatgtcccttaagccttacataaacattgacttacaccgaaatgtatcctatggctcttactaactgtaacttacttaaatcacccaagcctctgttttccctgctataaaatgtaaaatagctgacaaaatacctatttgtattttttggaaacacgggataaagcaaggcaagcaaaaagaacagcagagacaatgcttaataaatatcctagtaggatcaccttaatccatgaagaaaatggagtttaatttttttaatacaaaaaaactcaatgaagttatacttacgttaaattggtggttattttaggtcagtggttttaaaactcaacaatgaaactgttttcaaaaagagttgttatacagaacagaaaaaagcagccacaattttaaaaaagatatgaagacccagattctcactaactcattcagctcccttcatactccctccccacagccaccccagctcctgaggcaggttcccagggctccaaggaacatacttttaaaaaatcagtattttgaatacataataagtgatgtaacttaaaagtatggtgagaaagtcccattgccaagagaaacatgttaattttttatttaaaaaatcatcactcttttcattgtgacatcttgaagaacgctgaatggcttcaaaataactgcatatgccaagatttctggagtgggcacgtttgatcttctttcataatgaaaactgacaaacatttttaagggcatagtattgtttcttcactctcccccctcctcacccctgcacacacatacatttctccttcctggggaactccaaagaaaacaaaggccctttagcaatcaagtagattgtctctcttgatggcatcccatgagttatggaattacatactgcaggcccaggtggattagggcccctagaaagtttgcttgatcaacagagtgctgttgattttttcaactgaattaattactcttggagtccaaactctccagtgtgccacagtcctcatcacttcctgtatcttaaatattgcattatctgtcccctaaaagtatttgaacatgtgacccagagaagaggacttacaacttgactaggcaacttctgtcacactggattcatatgaaattccactgcaagtgacatcaccagattggggaccctgaagtgtttgagtatcttctccacatctggtcatttaggctaagaaattccttcttgtctaccaggtcttttagcattcattttgtaagtcattcaacacctacttactgagaaggaatactgggctagacagtgtgctaggggctggggaaaccgcaatgcataggagagaattcccatctccaagaggctcacagtcaaacagacataaataggtgattacaatatacactaacaacatagttttagaaacaactagcagaattatatagacgaagatgccaggaaaggcttctcagagaatctggcttggcaaatatctcaacaaagagggctgagcagggatgagccgaaggagaggatggaaagtaggttgtgggtgagttttccaggcagcatgtgcaaaggtccaggagaaagaggaaggagcctgtacttggaggaatattcgattactattatcagtgtcacacttgctattcatctagacagaagctcctgaaacaaaaaggatacacttcaaaagatgccaatatatccatgaccacacaaaagagtgtctagtcatataataaagggtgtacatatgcaggcaactcacatcctgccaaatattaaatttctaattttattataatttctaataaaacattagatttattattatacagagtcatactccttgattgggaaactctcaactcaataaacattctttagtctcatgtcttttctaaaggaaagaaattaatgttatattcttgggtgaaaaaaatgtgaggtctcaaaagagtataatacaatttggggatgcatatatattttacatgtatatagacacataaaaatctaaaagcataaattttaatatgttaacagaagacagaagtcatgtattttttactttcttctttttggcatatctctttttctaacttttttttttctttttacaaaaaacaattgttatttgtgtacttttaaaacctcacagtaatattttcacactaccttcttggctgaaagttcacactcggaattccagagcagtccatggccaggcccactgggctccccttgctctctccttggctttggtaaccactggccccagggactcagcctgctttcctatccatcccctcagtagctgtcaccatgcaggttaccccttctgtttcttctaccactaactccatgtctgactgcaagtgaaaggaacagaagcccaaacctttgggttttaaggagtttattgctaatctgtaaaacagaaagagacaggagataagcatgacaaaatatagggaagaaatgacttttgcctaaacttcccaattgtgtacaattgaagcctctgctttatagctcttagcacacctctcaaataagaaggcagtactgggaaggctctgaacctgtggcagaaccactgatagctgtggagctattccaaggagtctgggaatcagggggattatcaagatcattgttagaataaattaatcttactgtatatatagcagaagttttcaagcatatgtaaatgctactaataaccaaataattacaccttgtttttctttaaactgtaactctcaagtatgtctctacataattttttgattggtagtgtctgcatgctcaaaaagcttgaaaacactactggagaagaaggtctcgggagtgtgatgaaatacgtttacatggcagcttcatcatttaattggtgaaagtgactatgtgtcttaaactctctgagcctcagtttgcacatccaaaagcaaggatataattccatgaacctttccacctcaagtccacaaggcagaatagcaagatgttaactgccactctgaggaccaccaaataaaaggacaatttattaggccacttgccagcatggacacaatcgactcttggcatttcttattatccacagaaaaattaaaagtataaatatagaacaaaattatcgtgttttttttaatagtaacatgtaagatcaatctttgtctttaaaataccgtgtatctcattctcggaaagcgtcaaaatgaaaatggtatagtaagttttatctacaacttgaattaaaattattcttgaaatatgttctgaatggttagatgaaatggtaattaaatacaaatagagataatcatatactctctctccataaggctcccacctccttcaatgaagtctagttcacctaaaatgacactattaacattaattcaatattataagttgataagcacattaaatcaaaacacagcaagattattttaagagtctgactgaaatgtcaggatgagaaatagattaataaatattggcttctaatgtcggtaatgaaaacaaacacgttattttcagaaaataaaaggtcttcgtcattaggtacaaatcataaagggattatctacggttactacactgtaacaactttttacatattgtattatagaacaagcttttgagaagacaaagcaacacatcagcagtttaaccaattgtctttctcttttaacaggctggtctacattagattagatataaaaggcccaggtattacttgtgttcgatcttagccacatggctgagaaacatccaggtacatttaaatcagtgacaaaagaaaacattatcccttagtaaaattacataaaataggaaacatctcttactttaagagcaacgatggtacttgttcctatggtgaaaactgatgttatctcgattagttaattattcatcccaacacctggtcttgcttccttttccacctctagctatgttaacactagagttcagtaatttgttgataaagaatcttaactgcagtatctaacagatcttagtgattaagcatatgacttaccctttgtacagataagtaaactgaggccaaaagaactgaggtatcttattaaaaatcagagagctagttagttgaaaagtccacctgtccttcctttccacatgtctcaccagaaaaacagcaatggtgaaaagtcaactctgtttttaatgggccactttgtatattttaactgttaaaataatccaagaagatagtagtcatatacgaagatcctttagatataatgtgtaggaccagcattaatttaatcaaccaagtctcctctcattgaattgttaattcataattacaaagatgacattacagtaaattaagaaatactgtaatttcattctctccaaaaagtatacattgaagtttggtgaatactgttatattttcaactagtaaatcagtgtgccaattctgggtcttaggcatattgtatatactggaatgatattcactttaattaaatttgttttgagatgtagaatgtaatacagatcctacgtgtttttaaaagttcacatcaatttcaagcttttaaaaatgtatgtacacaagaaagcttcttttgcaatttatatgtttacaaatgttgccattagctaagctatattttggaatgtgatcaaacaatattgaatgtcaagtcttaacagcagggctggtctaaggaattccctctaagctaaatctgatcctttcatatgtggctactgctcttttaaactactgtatccctaaagggctaaaaggaagaaaatcctaacttaataagtgaaggcagcaaggcatagtatttgaatggctacctttcattttaactctacttcttaaattcacaattggatttgggtttgtttcaagttgttcacaatttactaacgaaatgtgcatctctcattcttcccccaaaagaaagaagtcatccactccagctacatataagtctccaatttctgtcttacaactaaacgtgaaaaccgaaataccactcattgaaaaaaaaaatatacagagaattggcaggctgcatgtttatgtgaaccttcagaaaacatggaaacacgcagccccaactcaccaggaaaatcaacacttgtgatcaaactattttgtgacattttatgtcttttatacatttcacttcatatccagtattccagttttgcaccggcttgcctgtatcaaccccaaatcgcctgagagcaatctagtactgtagcagaaccgtttcaacatgaagagttctgctcatcgcctgtggcgtggtcttcgaaacacctgaatcaaacattgattcccctccccctgctatttaaaaccgagggacgtcaggcttgggttgtaggtaaagaaaagccacagtaatcaaacaagcaaccaaaatacccgaacacggaacacgctaagaacaaaggaaacacaagagtgtgaacaggaaatgaagcaactctacacccataaataccttctggggccgccaacataggtaaaagtaaaggtggagtctgagtatctgaaatctgaaacagaaagtcctgtcaaaagctacccctggagtggatttgttttaaccccgatcaggacttgggcgctccatttggtggagtcaggggaggcctggccgggcgggtggcgagggctagagggcggcgaggtctctccgcgcagcgtcccaggggatgcggcgcgcccccgactgggtgcagcggcaggccgcccccggcagcaagtgccgggtgccatggcaacggcgggaatttcccagtcggggcggccggaagcagccccagccgggctcgcggcagcgaaagcaaaatccgatctctctcccgggggagcaaaatggacgaaaggcgaccccccaggcaggggcgctgggtgccttgggaatccgaggaatcccttctctttgccagtcggaggggactagatggagccgaaggggccggagatgggccgagcgctgccccccgggggtcctcggcgccggacgcagcttacgagcgcaacgcagcaggctccattcccggccgccgccgctcagcccattacgcaaacctggcgggtccaaccaaccccgctctgccgccgctgctggaacccatgaggcgtgcttgcaggcttcgggcactacgcggggctggaaataccacgcactgccccttcgcctagacccccgctcgggccacgcgggttctgccctcaaagctggtagctgccccagacttgggggtggggggaggggaaggggcgaggctggcgccccctcccgcttttggctcccgcgttcgttgcagcagctgttgccaaatgaaccccggaatgcggacgtgcaaaccctccaccccacccccagccacacacgtcgcggtcagagaactgggaagggggcgcggggtccgaggttctggaaaagcaagaactcacctgcaaacaggcagtcctcagctctggacttctggatcacgacgtcgatatccttctgaattcggtcttgccttgaacacatccccattaaataaatccttggaaaagaagcagccgctatttccaccccacccccctcgcacgctttcagctttcgtaaatattcagttaaaaatgaaacctctggccgaggcaggggctgaaggccaagtggtttcggaagtgatcctgggtgagaggaggaggaggaggaggaggaggaggaggaggaggaggaggaggtggaggaggagggggaggtcggctttccatttccagatgtgaccgcccagctgctgctcgccgctgctggattccaatttcctccccttctggcgatggattggtgatgaaaccgagtctcactttctccttcccccgcccggaccaaccgccgtggggggccgagggtgccggggacggccggagagcgatcaccggctgggcggcgggagccgacgaggggcgagccccgctccggctcaagcgcgcacacccctcacggcccgcactccggccttccacacccgtgcacactctcgcccgcgggcggcggcagccgtgcccaggctgctgcagcgccacccgcccgccgcggaccctccgcgccctccgcctagtcacccggcccggccgcgggccgccggggctcgcagagtgtcagccatcccgggcaggagtcgcgtctccccaccccgacctccactcgcgccgggagctgagcggcagtgtaggtagtgaagactccctggggctcccagccttccctctccgcgctctccccccatcacttttatgaattcgactccactttctaaaggaattatgagtcttgtggcaaacacaaaccggagtggccgggagggggaaaaggagggaaaagaaaatctttaaaaattaaaaaaataataaaacgaacaaatctttacttgttgccacctcagataacacggaaaaagccttgaaattactccagatgtgcaccctccccttccctcagtgcctgagtctttttcctccagatcgaagtatttcagcccttttggggcgccgtttgcgaaacacagccccttttgagggacttcctcctcttgaaaagactcaccagttctcccttcctaggtgtttctgttcatgagaaattgtcagaatcaactggcacgttccagggtcttcctaaaggatggaaacctgtttggcttgctttttaaaaccacctcctttgacagtcagtccagggaaagctacaatccaggtgttcagaaatgagatactgctctgattctcactttctgttctgcctaaggacacctcagggtgacgtagctgccccacctctatattggtttatgccctaggagaggtctccagcaggcacttttcttattgatcttttctccgctgagaaggctcccaccagtagaccatgactcgttttgctttgcattctcagtgccacgtacagtgcctggaatacaggagggtggcctaaatgttggctgaatgcatgaatggtcatttcttgcagcctcttttcattaccctgtctcatcagctttcttatcagaataagtgcccaagagtgccaaactgtttcagacccttaatcaatttagttctgattctgaccgtgacaacatgatgttcagcacggtaggaatgactgccatctctgaaggagtcttaagattctgtagaatcaatgaaagattctatgttctaacgcctttatctttcaggaaagaaattacaaaatagtttcattgtccagtcatattcactatgagttataagaggaaacattctatctagaactagaaataccatttgacccagccatcccattactgggtaggtacccaaaggactataaatcatgctgctataaagacacatgcacacgtatgtttattgcggcactattcacaatagcaaagacttggaaccaacccaaatgtccaacaatgatagactggattaagaaaatgtggcacatataccccatggaatactatgcagccataaaaaatgatgagttcatgtcctttgtagggacatggatgaaattggaaatcatcattctcagtaaactatcgcaagaacaaaaaaccaaacaccgcatattctcacttataggtgggaattgaacaatgagaacacatggacacaggaaggggaacatcacactctggagactgttgtgggttggggggaggggggaaggatatcactgggagatatacctaatgctagatgacgagttagtgggtgcagcgcaccagcatggcacatgtatacatatgtaactaacctgcacaatgtgcacatgtaccctaaaacttaaagtataataataataaattttaaaaagaacaaaacatcacattgtacgacataaaaaaaaaaaagttggattttgcaaggaagatagacatctgactaaagtttggccaagcaaggaatctttgttagtactacttcttgtttaaggaaagaagagacattcatctttccttcaaacagtataagtctcttttcttgtttgatcaccttttattcattaaggaccagttgaatcatctgttgggacttggtagcagaggatatttcctggatagtgtgagctatcaggcctttaatgtgggaagtttagtttctataaaaataaaattaaaaaagattaatagttggaacgaactataaagacagtttctgagcccagagggcagctgatcaataagatttctagatgctgggcttttaatatcttcagctggagtgagaagaggcattggattagtttgcagtttgaatgccataaagatgggccacacacaagctgttgtggtaatttttctgaagcttatgtcaagtcatccagtttcagtttgaaggacttcaagaaaagaaaagtttataattttagtgattccaagccagaatagcaggaaaaaaatgaaatattaatttggagtattgtagctaaatattgtagtaaactagaaaaattgaggatctattgcagattgcaggcagataataaaacctcagaaaaaaaaaaaaaaaacagctagaatctaatattgggtgcactgcagttttctcccgaaacataacttttctctctatattcactctcatttctgtcaaagataatcaaagtcagattgatttgtttgctaaataagtttaatctcattaaacttgtactgtttatgtacacaagtgcagttaagagtagtgattgaccatttaggctcttttaaaggttgcgtttgtcagataagaaatctcagattaaactttttgtttttgtttttttagacagagtctccctctgtcactcaggctggagtgcagtggtgcgatcttggctcactgcaacctccgcctcctgggttcaagcgattcttctgctcagcctcccgagtagctgggattataggtgcgtgccactatgcctggctcattttttgtatttttagtagagacagggctttcaccatattggtcaggctggtcttgaactcctgaccttgtcatccacctgacttggcctcccaaagtgctgggattacaggcgtgagccactgtctccagtcagattaaacttttaaaagccacttgaggctgggatacaagcccaaaacttgtcattagtctgcacctgttacatttatagattcagataaatttctctcttcttgaggtccctaaaatatcccaaggtttccacacctgccaaacagtgacattctttatttacctgtaagtctgggaaccctagagccagtttttccaagatggtactttattggttccataaagccaaccttagtcccctaaagccttctggtcatatctgaaaacatgatgtttcagtcaaagccttggtgatataacctgtgtttccagtttgtcctgttacaaagacaacagattcttattaaacttatgcaaataaatactttgccataaaaataagaatatgcacaaatagtttccaaattctggagggataagttagggagaaaaagtaaatgtttccattttgcacaaaagtattctttactgaattggtgtaagctagagatagcttaaaaaaaagttttctgaaatctggaaaacaaaacatttaaagaactagcaatgtttccaacaaaaagtcattttaaaaattattctcatcagttcattcagtaccacgtaattaaatcttgttttgcttgatcttgggttagtagttacatgaacccgtcagttttattagagttctggaaattcttaccagtccaattgtatgatgttaaagttgttcagaaacctgtattccagaatactcataagagtattttccataaatctccttgaagaagaagccattttggactgtagctaatttcaaatgcttttagagaacaagtaaattaaaacaatgactgtctacagatgacaaggacttaaaatgtccatggttaaaaaatctaatgagagttcattacaatgatgcaatttataagaaaatttggttagcatggcatacagcattttaacataataaccaaaattatgactgataacatactagatttctaggaatctcatacaacttttgtacacttatcccaataatatatccataaatataacttaaagatggcttagcatcactttttatttgaatgctacacatataatttagcatattaaataaatctaattggtttaatctctctttcatacaaaaagaaatattctttgtggctttctgagggtccaatatggagaatcctaagttaatttgaggtcaaaaagacttaacttagaatgtgattttgggaagattgtcaaaaatgtcaaaaagtttaaaacatttaaaacaaatattaccatagttatctatttaataaaagctccattaaaagattttaaaggcaaattcagattacatagttgtgaacaagaacttagctcctttaatattgagaagactcacttttcttaagtaaccaaaacctaataaaacaacatgaaactcaagaaattatcttgatgaaacagtctctgtttctgaggccaattacttaaaaggaaaaaaataccctttacattctcagaccaacattccaagaaaactttaccattttaacggagaagatcaaattctacttttgaatcaatgtattactaaaactaagttttaataaaaccttataaataaatctatccaatctcagtcagcttagaccatacaagataagattttcacaatccttctagatatgttttcttatttacatttgcaacagacatacaccagacaattaagcaatttacttttactacatatcctattcttaggttgaatttatggttttatggccttaaacatctaacagtaacaacacaaacttgtctaatcagcaaagccaggtaaaataagtgtatgctgacagttctgaaaatgtttctatttttattttaccaatattttttaaactagtttttatttactaaggaatatcccagattatgtgaacctaaaaaaaattgggtcagtttctacttttctgaaaattttatacattcttatttgtttgagtgctcatttatccctagccaatttgggtattttagtttggtaataacgttggaggtagaaaaatatcacatatacataacataataacatagatacacacatgtacacatacacaaacatatagactgatgtaaccagatcttatgacttttcatttaaaaaattttaaccaggccaggtgcagtggctcatgcctgtaatcccagcactttgggaggctgaggcgggtggatcacctgaggtcaggagttcgagaccagcctggccaacatggcataaccccgtctctactaaaaatacaaaaattagctgggcgtggggcatcgtggcgcccggctgaggcacaagaagcacttgaacccaggaggtggaggttgcagtgagccgagattgccccgctgcactccagcctgagcaatgaagtgagactctgtctcaaaaaaaaaaaaaaaaaaaagtttttaaccatgaggcagtaaaacagagtaatacaaaaatacaaactcactggtttatctccactttatattgttatccaaattgtgtttctggtgagaaagggataagttgagttgacctacataacaaaggctaaatctttttaccaatatttgtggaggaggttttttaagattttttttttttttactttatcagtttccaaatagtttctttttttctcctattatcagccccaggtgcttgtttttgaggggcctctgagtcccttgagagccccctcaaaggagggtaggataggggtcctgaagttcagcagaaaagaaacgggtctggcaagagtggacagagaaatagtcagcagagacttgagaagaggggtttcaggtgacagagctcccatgggagaagcaggatccaatagagagaagagaaagagcagagtggttttatagagagccaggaagaacaatttgtagctcagggaatcagggagtaacccctcactcagaaaaagagagccagaaagaagagacttctagtctagggactcagagaatagatcactcagaacaagaagcccacaggaagaccttcctgcccagaggattcctttcaaaagaagcctgggactctaccccagcttcagagagaatattcatcccttaagattcaaaatctgtccatagccatcaacgggcttttgtgtggagcaatggctcagaaatctgattcaccaatggatccctaatcagtcagaaatgacaacaaagacttcaaaggcatgcatttagggtcctgagtgagaggcccaggatccagtgatgaatctgtttcaacaccataattgttaaagaaaaaattattcagtgatacttcaaatgcacagtaaagaagactttattcaggaccattaccatagatataggaaccactgcaacacagtcttggagctggggagagagatgggcttaactctgaatacagcacggggaagtgggaatttatagcccaggagcaatgcaggggtcagtgaatggaaaatcactaagaggaaacatcaggagtaagggagattctggctaaaccgccctaaaagaattcttgctgaagactggccagggtgatcagacatcacctgcagaatggtgaagaatgaagaacctgatcagatattgagaatgagggggtctttggtaaacttggcagtgttctttgctaatgctggattttgtgaggaagtgcacagtttagcctagctgaagatttagaagcctgactaaagttggccaagcaaagaatctttgttatcaacatattccatcaaacctcacatccctgccttaaatgatcaaaccatccgcactcctgtatgctactgttctccatgaaaagttacttcttctttgtcttaaccaaaatccagccattctagaaagacaccagaaggctttctgcagcatctaaaatttccccacattctaggcccaaatccttttcctttccctgttgcttttagatccacattgtgtaaccctcatctagaaacctcagtttcttggagtcattttttttttttgggacggagtttccgctcttgttgcccaggctggagtgcagtggcacgatctcagttcactgcaacctccgtctcccaggttcaagcgattctcctgcctctgccccttgagtagctgggattacaggtgcctgccaccatgcctggctaattttttgtatttttagtagagacagggtttcatccttttggccaggctggtcccgaactcctgatctcagaagatccacctgcctcagcctcccaaagtgctgggattataggcatgagccactgagccaggccattctgtctttttatataatataacttgtacttttatgtagtaagttatcacaatggtgtcagacactctgaggaagagtattttactgtatcattcccattacccaatcaggaagtcttaacaggcagattttaacaaaaatataagacacaactgtgcctagcttttctcacatacttcctacctcacacttcacacatttctttttctcagcacccactcttaagtaataatttatttcccctgaatattatttaccttctgtgggctaccttacatatcatctgaaagcatgatcaaaacagttatatttgtgaataattttattttggtttatttcttagcagaaggaggagttaatagtaacatttgtaggccgggcacagtggctcaagcctgtaatcccaacactttgggaggccgaggcttgcggatcatgaggtcaggagatcgagaccatcctggataacacggtgaaactctgtctctactaaaatacaaaaaaattagccgggcatggtggcgggcacctgtagtcccagctactcgggaggctgagggaagagaatggcgtgaacccaggaggtggagcttgcagtgagccgagatcgcgccactggactccagcctgggagacagagcgagactccatctcaaaaaaaaaaaaaaaaaaaagtaacatttgtaatctcccagagaatgccaaggaaaacattctcctggctgaatttatgtagagttcatcatctaagcataaaatattttataaaggaatgggccaatcaaataactgctatgcggttgacactgtaaaccaagttagcttagtaccactctaaatagttgctgggaatataatgattttcaaagacatgatctctagaaataaataactaaaagagaagcacggtgtcatgcatttatgcatacacataagcagggactagagatcaagaatagaaataaaagaggtttttacacttggggtgctaaggtcgcaatgatttatttggagagaaaacagaagcccttctttagtaaatgcaaagcaccatgtgtttaatgaagatacatgacctaagctttgaagatcgtttaactaattcaataaccttaccaagtatccattactacatctcaacaatcaaatttacagtgacatctttgagttaaatatctccatagatgtctggaaacagcttaattctgttaactgctgcccattgaattatgcttaatttggttgtagaatttcatgtcatctgttattctccctcacaacttgggagacgttattcctgtattgtctgttctcgttgatgaagagaagtctgtgataaagtaattgtccttcctttgtaggtaatctgccttccatctctggttgatttgaaaatattgtattagtctttagtatcttgcattttactgtggtatgtctacatatggatttatacttactgagtttgctcagagcttggagtatttcctcagtcttaaaggccctagttgtgaaaatgttactacagaaaaactttatttttttaacttaaaatcctttttattgggaaataaatgtaagattatagataagtttgaaaataaaagaattgttagaacaaaaaatactcatatgcctgttaccctaatttgtctattattattttattaaatttaggttaccatttgttctctctctctctctctcaatatatatcccaattttcagtctttagttctaaatctttcagcaacctggactatcatggccccagtgtaatgcttggctttgtacctcatgagggaagacattttttttttaatcttaagttctaggttacgtgtgcaccacatgcaggtttgttacataggtatacatgtgccatgttggtttgctgtacccatcaacttgtcatttacattaggtatttctcctaatgctatctgtcccccagccccccaccccctgacaagccccagtgtgtgatgttccccactctgtgtccatgcattctcattgttcaactcccatctgtgagtgagaacatgcagtgtttggttttctgtccttgagatagtttgctgagaatgatggtttccagcttcatccatgtccttgcaaaggaagtgaacttatccttttttatggcttcatagtattccatggcacatatgtgccacatttttttaatccagtctatcattgatggacatttgggttggttccaagtctttgctattgtgaatagcaccacaattaacatatgtgtgcatgtatacatctttatagtagcatgatttataatccttcgggtatataccctgtaatgggatcgctgggtcaaatggtatttctagttctagatccttgaggaatcaccacactgctttccacaatggttgaactaatttacgctcccaccagcagtgtaaaagcattcctatttctccacgtcctctccagtatctgttgtttcctgactttttaatgatcatcattctaactggcatgcgatggtatctcattgtggttttgatttgcatttctctgatgaccagcgatgatgagcattttttatgtgtctgttggctgcataaatgtcttcttttgagaagtgtctgttcatattatttgcccactttttgatggggttgtttttttcttgtaaatttgttgaagttctctgtagattctggatattagccctttgttagacgggtatattgcaaaacttttctcctattttttagattgcctgttcactctgatgagagtttcttttgctgtgcagaagctctttagtttaattagatcgcatttgtctattttagcttttgttgccattgcttttggtgttctagtcatgaagtctttgcccatgcctatgtcttgaatggtattgcctaggttttcttctagggttttttatggtgttaggtcttacatttaagtctttaatccatcttgagttgatttttgtatatggtgtaaggaagggatccagtttcagctttctacatatggctagccagttttcccagcaccatttattaaataggggatcctttgagggaagaaaattatttctaatattttaatccagctatgtatgtaaaaagaagtctttttcatattttatctgttatttctgtatgattggagtatgagtcaaaacatctcaatataaataaaaagttacatttcagtaatttttttttctaaaattacaaaacactagtggtcaaaaacactactatttccaattctctttcctttgttaacattactttttgtacttatgagagaagagtttgcaatccaaaaagagcaggaaggaagagagattagagattttttctcctgcttgctctatacatatgagatatttatatatctatatatcaacagttgacctttgaataacactggtttaaactgtgtgagtccacttataggtggattttttcagccaaatacagattgaaaatacagtatttgtgggaagtgaaacccacatatgtggagggccaacttttcatatgcaagctctgcaaggttgactgtaggacctgagtatgtgcagacttcggtatatgcagggctcctgaatccaataccccactaatactgagggatgactgtatatgtctctatctatctactctatcatatatatatatacacacacacacacacacaaatatgtgtgtatatatatatgtatgtgtgtatatatatatgtgtatatatatatatacttcctatattactttgctagggttgttataacaattactgcagactggatgagttaaacaagagaaatttattttctcacagttctggaggctagaagtgtgaggtcaaggcatcagatgtgttaattttattctgaaatttctctccttgccttttagatagtcattttctcatcttgtcttctcatggacttttttctgtgcacatgtttgtctgtacctaaatttcctcttcaaataaggacaccagtgatattggattaggacccagacatgtgacctcattttacattagttacctcttaaaagtctctatctccaaatatagtcaccttctgatatactgggatggcagggggcagggtacagcatattaatttggggaaaggccacaattcagcctataacatatgcaatatattcttctctgatctatactatataacttttatatataatacatatataatttaatatacattttaaccccttgattaattttgtcactgcagagaaaacaagaattaaagaaaagcttcaggtgatactgtttttgaatgagtaagaattgagcctgcccttaacacaagaatgaagtagaaataaactgacttagggaacagcataaaaaagttctcttatgagtcaagatttcaatgtgatgtcatcattttttccagggattaaatattagaatatattgcatgcccatattgaggtggaatcataaacttatttcagacttattataatggctcattttcttatgccttcaccattgaacttgtacttagctggggattgagctgaaagtttgccttttctgtatctagcatagttgcaccaaatctgaccttaatcccaaattttcctttctgtaatatcttgtttccaaatgaggctcacattgaattttctcttgttagaaatataactggcaagaccaatcaaaaccattcattccattcagttgcctgtgaacaagcttgatttgctttgttattaatacagattcttgtgggttaagtagaaagctcttttgtaaatatccctcagtttaagtatatatagtttacatttccaggtaaactgtaaattctctgagaaaggcccagcatggtggttcaagcctataatcccagctctttgggagtctgagatgggtggatcactggaggtcaggagtttgagaccagcctggccaatgtggtgaaaccccatctctaccaaaaatacaaaaattagccaggcatggtggtgcacgcctgtaatctcagctactcaggaggccaaggcaagtgattaaacccaggaggtggaggttgcagtgagctgagatcgcaccactgcactccaacctgggtgacaagctggactctgtctcaaaaaaaaaaaaaaaaaattctgtgaaaagatctgtgatttccattctcctttatagtaattgttaagcactcacaattagatggttataacaactatcaaagaaaaacaattattttaataaatatttttcatcattttctcctttctaagccctatgctatgcactaaaaactgcagagaaaatcaacacattctctacctcacagcagatttcttggagagagataggggtggggaggggaataagggttgctaaatgttgtcaactttgtaatacaactctcaaagggagatagttattagggaggcaaagtgctcaggctcagatttcaggttgcctagatttgaattctgtcttcactgcttcttttatgatttgcccaaattacttaagctctttaaaccacagtttcctcatccttaagagagggataataaatagaacttatctcataaaattactgtgagaattataagtgattatgaagttgattaaatttccccagtgcttcatacaaagaaaggactcaaaggatatgctagttcatagtaggggcatagaagaagatatcccttctctcctgggatatagggtatacataactgtccactataaaattgaagataggctagagaaaagctaaaaatgaagaatctaataactctttagccaagagaaaatgaaacatgagggaaagggagaagttccaaatgaggtccacatttgtcgtgggccactgaatggtggtgccattcaggcagaggaaacccagaaggaggagtcattctgtagttagagggcacttaatgagataatattagagataactgaggttgagttgttggtacgtatctgggtgcaaagtctccataggtccggaattttgaatagttttctggagtcatctggttattgttaaagccaagagaattggtgagatcacagaatacaataatgatcaataagagggaagggaagagagccaagaatgggagactgggaagcatacacatttaattaaggtttggtaaggtgaaaggtgtcagcagagaatgtaaaggtgaaataatgagagaaaaaggaggacatcaaggagaaagtcgtgttttgaaaaaaacaaaaaggacacattttcaagaaagacattgtcaatagtttaaatgtcacaaaatagtagagtataatgcatttaaaaaaaacaaaatctattgcttttgttaattaaatgactagtaacctcggctgcagcagtttcagtagagtgaggagagttgacaccaaactgcaccagtggagtgaaaataagtgggaagaaagagtgaggaagtggaggacagtctttttttttttttttaataaaaatattttcccaaactgtcttttctggaacttccaacatgtctgcttaagagcttgtcttagttgaattcattcgaacttcttgaacctaattagtttctttttgctgtttttttttttttttttttttttttttttttgagatggatccttgctctatcgcccaggctggagttcaatggtgcaattttggctcactgcaacctcctcctcctgggttcaagcagttctcctgccgcagcccaattagttttaaagacgctgcatatattggcagggaaaacctagaacacaaagtcaaacttccaattatctcccttcagtgctcaaatcaagagttcatttgttgcaaggaatggggatctggactccagggagaagaatagagttttaggaggaaagttctcctaaaactaaatggaaggagggttctttgagataccaaggatttgcaggactttatttacaatgaaatgttagtttcagacagcccaggaggaataggtctattaaaggaaagcaagagtagttggcgtaaggaaacaatttgcactggagcctgagagtgagtatagtaatgaccacatgagagacccatttgactcaagtacttcaaagcattgccagtgttagtctttgctccataatcaagtggggaaaaagtgaaatgtctttgaagagcatttcctgtaggtggcctttgaggaggtcctgaaaattccaaacctgcaagtattaatggcaaagaataaaaatttgtttatataaaatacttttaaaaatctttctaaatagcaagacattatatattatcattgttaaaagataaacgaattgagaaatatcattagaattatatgcagcagataaaatggtcacttttttttttgagacagagtctcgctctgtcgccaggctggagcacagtggcgtgatcttggctcattacaacctccaactccctggttcaagtgattcttctgcctcagcctcccgagtagctgggattacaggcacgtgccaccaccccagccaatttttgtatttttagcagagacggggtttcaccatgttgggcaggatggtcttgatctcctgaccttgtgatccacccgccttggcctcccaaagtgttgggattacaggcgtgagccactgcgtccagccaaaaggtcactttttaaacttaaaaattattaagaaaacagtgaaaacttaatgtttaaaagagtagaagatagggaaaattattacacagaaaaagataaacaacagagaaagataaataaattgccagtgaatatgtaaaaagttgctcagcaccagtggtagttcaaatccaaatagcactgagttagcatttgttaactaataaattggcaaaaattatattttgataaaacccagtgttgttgacatctcaagaaaaagggctatgctcacacagccttggagcatgtgcacattgatgattttgttggcataaaaattagtggtttctattaaaatcagcagtgtaattcacaatcgctaagacatggaatcaacctaggtgcccatcagctgtggattggataaagaaaatatggtacatatatgtcatggaatactttgcagccataaaaaagaataaaattatgtcctttacagcaacatggatgcaactcgatgccgttatgctaagcgaattaacacaggaatagaaaaccaaataccacatattctcacttataagcaggagctaaacattgagtacacgtggacacaaagatgggaacaatagaaactggggactactcgagggtagaaggagggagggggtaaaggttgaaaaaaaactactatgcctagtacctgagtgatcagatcaatcatgcagcaaacctcagcattatacaacatacaacatacccatgtaacaaacctgcacatgtacccactgtatctaaaatcaaaagctgaaattataaaaaataaaaaagaaaatcaacaatgtgtatttctctcacacagccatcacgatgatgtatttggaataatatatgcataaggatgttcattgcagtgttgtctgcaagggcaaagtgaaaacaatctgaataaccatcaatatgacacagagtaagtaattattggtacgtctgtacaatgcctcatgcagtcaccactgacagcatgggaaagagagacatctattatgaaaagaccactaagacatatgattacatgataagtgcaaggttcatgaataaatagtatgtatactagtatagcatacttctttctaagaaagaaaccataacacatacacgaatggacaagaaattattaacaatagctaactttggtgataagactgtaggttgtaaaaagccagactttcatttctcattttaaacccaatgaattatttaaatctaaccctactgcattcattatctttataataaaataaatatgtataacaatgaaacatagtttttaagtatttgggacataaattaaacattaatagattacacctcttaaacttggtactttagtatcccatttctctgtgagaactctgaaagcttcatcttccacagtttaggtaattctttggtgtcttattttgttattttcttgccctgagattagcaatgtcagatctccaaactactaactcttctctttggcagatcaaatgcttcttcttaaaaaaattgattttttaaaatgtatttcataggatttttgttctctctctccctctttttgtgcatatgtgtgtgtgtctgattagtctttattatcttaaaatggttagtcctgatagacctgtttcttcaaaatttctctcagttctttggcagtttgctcttagcttataattaaagatcaatttctgacttgtcttgttctagaaaacctcaatggaaattacagcaagctgaataggatattaattaaaaacataaacctggtgaaacccgaacatagaggctctagttcaaagatgcttccaatagttgacatggccattcattccttaaaaccagctatttttctttcgaattacattacctttaattctgtaaattggatgttatatagtaccatgaaaactgctgtgagtaattataatactcattgctgagtgatgtgacttctttctcaaggctatttctgagggaaattgtacaattagatctttaggtattgtgacttgttttggaaatcatggtggccctccagggagctaatgaatctttaattatttagaggttcacatgagaccccttacagatataagcacattagctctgtagctaagggaacatttaaaaacagtaacatgaaatgtgtcagacatagaggaaagatgaagaagcaagtagaagctaatgcaaacagaggaactgccagctctctgtggcactctagctctctctgtcagtatttggttggcaatgtagacatagtggatgagtgcaattacatatgttaggctcattctgaaatgcaggagcattttagattttcatgtagaagcctgacaagcaaactacatctaggatatactttgataattttgagttgagagccaaattttttgaaggtaaaccatctccctgttttaaagtagtgtttaaaattataaaaatattaatacatctgtaacataaaatatttagatataaatactacaagtgcaaatgaatttttttttctacttctgcattcaacttttctcttctccctttagggaaaacacttttgtgtaaaggcctccaaaatatatgtagaggcgtatgtatgttaaaaacatgtatacatataatgcataaccaaacaaatgaaatatcctaaacatatggacctgaaaattgcttataataaatttgaactgaacatataggcataaatgtggttcagaagtgtccagttgaagcaacttcactttgttaggtcaacaaaagttggggacactaagatctactcctctgattttgttctagcattatcttaatggaaatgtttactgaaatggaaatacatgtagtggacatcgtggtggtgtctcaagcattcagtgttccctgctctcacacactcctagccaaataatgaatttctcagcttcacaatgtttaagtgacatgagtcccatgtccaattcttggtcactgtaattggtgcatgaaggaacgtgtgccttctgctaatcaaatcagaatgaagtacaactttttcattccatgattgaagagggaaatgccttctttccaaatgcagcagaggaagcacgaggtactaggattggaagttgtctactcatgacatgatattttaagccatagaataaaactgagacctaatgtcttagtcctttcaggtcgctataccagaatatcacagcctggatggtttatgaacaacataaatttatttcttacagttctagaggccaggaagtccaagatcaaggtgtcaacagattcagggtctaatgaggatttgtttcctggttcacagacagctgtctttttgctgtgccctcacatggtggaaggggctaggaagttctctaaggtctcttttataagggcactaatctcattcatgaggactctgtcctcatgacctaatcaccccctgaagacccactgccaaatatcatcacactagggattagatttaaacatacaaattttggggggatacaaacattcaatctatatcacttaaggtagagtgaagaaacagggaggacaagaagcatttattttgtgttattattaaacttctgcattaaactatcttgagcctatactattgttcaaaatctctttattatacaagccattttgaattttgattgtttgcaaccaaaattaacctaataaattaaaatgtactataatgttacatcataatttgtctgtactagtagtatttgctagaacgtttaggggaatacttgcttgttaactttttagtaaatataacactccatgttcaaatacatttggaaaatactgagcatttcacacttttagagactcaaaacaggcagcacatttttaaaaaataaaaataaaaccaaatagcattgcatttggagaatggtataaaaaaagagaatttgataaactggagttatcagaactcagtggatactatgtgttagacattattataagccattaaacattttacaagcttgatatctgagttaaaaattaataacccaaagacacattggaagagaaaagttgacatatttttattatattaatgacctaaaaatatcatagcaactaacgtcattatagtcaacaagtgaatgaacgtaaataatattaaataactattagaaagtctctctgattaagcatggaaataaataagcagtgcttttgaccaataaatggaggagttacaatactttccaatacaaaacaaaaagattctaaatgtaaaggtattaggcccaaaatatgttagtcaattcatgacagcagaaattcagcaggtcatatttttgaggtaatgtaaatgacaatagaaatcatggactaaagtgtaacaaataagtaatatctaggcaggtggaaattttaagatcttttaaattaacttctggactatagcaaaaattcaaactaaaattcatcagggagtcagggaaggtcaaatgaagaagcatggggactgaggcaaaaaccctgaattataccaatattatctttttttttttgagacaggatcttgctctgttacccaggctggagtgcagtggtgcaatcatagttcactgcaaccgcgacctcctaggctcaagggatcctcccacctcagcctcttgagtatctgggactacagaacctcatcaccaaaacacccatctaatttatttattttttgtaaagatgaggtctcactttgttgctcaggctgacaagtattatcttaatgttatagaaaaaaagtaattctggccatatataggtattattctttgcagtagaatatcatttcagaaatttgtgccaaacataaaattagttttctagtagtaaaaagtaattaaactctttaaattattattacccctagtatactggggaatgggtgtgtgttccaaatgaaaaaacttgggatgtctaatgagatgctgttttctgtcgcagaaaatctatgtaaaatgttttttctcacgtgtacactgttgatatttgagacagcacatgttaacacttcaagaagtaaaataaatgtgttgattatatccacagttttcatatttattaactacatatttcgtttttaatgtaatgcctattgaaaaacctgtaaatagttgtttcttaaaattgacaaatactgcctaagatttttctgtatattttcatatttcaattttcctgtgaggttagaatgaacactttagctaagacatttgtgcctccaaatcctaaacctttcagaatgttagtttattatttggtttttacctaaattattttctgcttattcaagaaccttaggtctatccagttacgtttttatttttttatttttatttttttattttgaaacaaagtctcgctctgttgccaaagctggagtgcattggcatgatctgggctcactgcaacctctgcctcccaggttcaagtgattctcctgcctcaacctcccgagtagctgggattacaggggcataccaccacacccagctaatttttgcatttttagtagagatggggtttcaccatgctggccaggctggtctcaaactcctgacttcaggtgatctgcccacctcaggatcccaaagtgctgggattataggcatgagccaccatgcctggctgtatccagttacatttttaagaccagccaggcttaatatatatttggtcttttgctcaattcaatttgttgcattttgtccattgtacttcatgtgacacagaatatatcttaatttaaaaagacatatgtttgttgagctatctgttacgttggtatatcttggaattttaaaaaatataaaccacagaagccaattatggctgacattaacaataaataggtttatcacagaaatagtggggaacttgtagaactgttgagaaggctagaaagccagatcaaagctaggcagccaggaaatgtaccccaaaccatgctgtagaactcatccagggaggaaaccactgtcaccaccagtaagaaataacaccgaagatgcaggcagcaacaattgcagcaattgctcaatcctaggctaactgcaaagccaccagcaccactcccacttgttcgctttgcaacagatattgtagcagctgctacatggcctccaccagaaacaagagaaagcataactgaatctgcttctttttttattaattccgaagtggaaattcagcactggcaaacagatgggcaaaacctaagtcatatgcttgtaccctagctgcaaaggaggctgagaaagcaagcatttggcattttagcttctaaagcaggaggtggtttcttgttttcgtcaaaactgagaggctgaggaattcctcaaacacagcaacaaacatcaaataataaattttcatgctttaacttgctcaatatcaatataaactttcccttttgaaagtaaacacgaaagacccaagcttccttctaacagagtgcaactatttctctaataattgaacatgtacctacaatctcttgaacaatgaaacaataaaaaattctcaatcacagcatgtactctaagtctaagaattctgggttatgtccattcctctacgaagttcttcactatactctcttgacattctgccatatatcatttaaaaattaagttaatcaccctcaataagccctgttttaaaaagagggataaatggagaggaaagaaggaaagttgttaagatacataagtatgcacaggacaatacaagagaaacaatgtgtttggatgtcaaggctctcctttctgcaagtggccagcaggtcactattggcatctatggccatgtgccctcagctaacacctctgctagtcagggttttgccttgtgagatgaccaaatattcattcctgacagagaaatgtccttgataatctttttgtgtgagcgtgccatggtcattgttaatttctttcatttaacaaaataatagactttattttttgagcagttttagctttatggaaagatcgagcagaaagtacagagttctcacatactgtcacctttatcccacccccagtttacattagggttcactctttgtgtggtacaggtctaggagttttgcaaaacgcataatgtcatgtacccatcattacattattaccaatgtattttcaatcccctaaaaatcgcctgtttcagaactatttatctccctacccatccccaaactcctggcaaccactgagcttttttgttgttgttgttgttacttagtttttatttcataatcataaacttaactcaactctgcaatccagctaggcatggaagggaacaaggaaaacatggaacccaaagggaactgcagcaagagcacaaagattctaggatattgcaagcaaatgtggtggaggggtgctctcctgagctacagaaggaatgggtctggtggtgaaaataaaacacaagtcaaactcattagaattgtccacagtcagcaatggtgatcttcttgctggtcttgctattcctgtacccaaagtgctccatggcttccacaatattcacacgttctttcaccttgccaaaggccacatgcttgccatccaaccactcagtcttggcagcacagatgaaaaactgggaaccatttgtgttgggtccagcatttgccatggacaagatgccagaacctgtatgctttcggatgaggttctcatcatcaaatttctccccatagatggacttgtcaccagtgccattatggcgtgtgaagtcaccaccctgacacataaaccctggaataattctgtgaaagcaggaacccttataacgaaatcctttctctccagtgctcagagcacgaaagttttccgctgtctttagaatcttgtctgcaaacagtttgatggagatgcggcccaagggcttgccgtcgacggtgatgtcaaaaaagacgacggagttgaccatggctgatagtacagggctcacagtgatggtggcgtctgcaaagataaccactgatctttttactgtctttatagtttgtccttttccagaatgtcgtatagttgaaatcacagtatgtacccttttcagactggcttctttcacttagcaaaatgtctttgttttttctgtatctttttgtggcttgatagttttttccttttagcactgaataatattccactgtaggaatataccacagtttgcttatgcagtcacctattgaaggataccttggttgcttccaagttgtggcagtcttcattaatttctttctttctttctttctttctttctttctttctttctttcttctttttttttttttttttttttttgagacagagtcttgctctgtcacccaggctggagtgaagtggcacaatctcagctcattgcaacctctgcctcccaggttcaagtgattctcttcctcagcctctggagtagctgggattacaggtgtgcaccaccacgcctggttagtcttcaggaatatttacaggactgtatagaattaggagccatcaaaggggatccctgaattctttctgtttttcttacaaataccagttttaaggtcaagatttactaccccatgcaacaatgtagccgcattttaaattttaaatttttgacagtttgtttaaaggtctcaggcaacctaaaaggctagatagaagtctctcatcctctaacgaaggatggattgtaaaatggaatactgctaagactctccctttgggtactaattctgcaaaaacctagaatctcagagacaagagacaagtatttggagtggatcattagatgtaatgacaaaaggagtcacttcaacgttcataacaaatatcaaagattgttgtattttttatatgggagacaccagacaagcttatacttagttactagttcagaggatacaccaccacatcgtctagcatgagtacaaccttataagccattgtctccagctggcactgtgattgagtctttaataaaatattcaccattgtataataataataattttggttggtgataggataaatggtggaccaggtgagtccaatgaatatctactcatttgttatacaacaagttcttttaatagaaggatgtagaacaggatattatggcagtatatataaggcattcaatgtacccatggagagtggcgatcagagaaaaatgatgtcaggtaaagcaaatgtaattcaaggataaaggtagattccatttacaaaattccttgttgcctttatcatagaggagctccagtaaaatcaacaagtctgacaaaaggtgactggtttattcacccaggatatgttattgtgtgcttagccttggactttgttgcttgtgtgttggacacctaatagtcttgacagctaaataggcttttgtaagcgagagtggtaaagtccaacatgttgctaaacctatgtgtattctctactgctaccaccaatgttgctgtttattagccttctgagcaagcaatgtagtgcctggtgaaagagattgtttcataccttcatatctatttgataaccttcctgatgatagtttggtgagcatttgtattaagcacaaatattcttacactctggctcattttctgtggttcatctacatattttttccccaaaactcattgccaccaatccttcagtgtttgtctttctgagtccctaattatcttttcttttcttttcttttttttttttttttgagacagagtttcactttgttgcccaggctggagtgcagtggtgcaatcttggttcactgcaacttcttcctcctggattcaagagattctcctgcctcagcctcccaagtagctaggattgcaggcacacaccaccacatctggctaatttttgtatttttagtagagacggagtttcaccatgtcagccaggctggtttcgaactcctgacctcagacaatccacctgtcctgtcctccaaaagttctgggattacaggtgtgaaccatcaggcctggccccaagtccctaattatctagacaaattattagctgccacatatacatcaataatatctctccttctagacatcgtggacaaccaattacataggctgaatttcttttaaaattgcattcacgtaggttataatgcctaagcaatctacttttggctgttgctgtgatgttgtacagtgacttctgtaaatcaggctcaatttttccctcactaatcaactggccatagagaacttcccatgaagacataggtatagattctattattcctacctgctgatgaagcaggatagttaattggaaaacacttatttcatgataagcagctcatgttgtcatatttttttgcattgataggacttcagtttctacaatggtccaggatcaatcaagagttctttaaagaaaacatttattttgtcaaagaaagaagcattttgttccaaatcctaagaacaatagtagtggtgtgtcagaggctctattgcatctggatataaaaacaaaggggcacaatattcctgaccagttgggaattattatcttgatctcaatcccatcaaaaggtggcagcatgacaagtcatgaagtaaaaggaccaggtgataaaatgaggtctccaaaatccaaagcatcaaagttctcagttagtggacagggctgcaaagtgccataatttttcactttggaaggtatatcttgagaatattgagtgtatgagacaagttaaaaggtcatgcagccagacgcggtggctcacgcctgtaatcccagcacttagggaagctgaggtaggcggatcatgaggtcaggagttcaagaccagcctggccaatatggtgaaaccgcatctctactaaaaatacaaaaattagtggggcatcgtggtgccctcctgcagtcccagctacttgggaggctgaggcagcagaatcgcttgaaccctgaaggcggaggttgcagtgagctgagttggcgccactgcatccagccttggcaacaccgcgagactctgtctcttaaaaaaaataaaaaaataaaaataaaaaaatttaaaagctcgtgattaacacctctgttagcctctgatctttataataattatcacacacacacaaaccaaacaccacacatagaggaaacagtaaaagattaaaggacacagctaaaaatacatttgtattattacttcccaaagttctaaaattatgagaagggactagtgaatctttaaaaaatattgattatccaacactttttaataaccagtataattgcattgaaggctactgaacatgcacatgttcctaaaatttttctgttatggtgtctggtttgcgaaaggaacaaaattaaacatagttccttggcaatttttccctcttccactctactaattggcgtatgtgcgatgtgtgtttattgtaaaataggaataagattcagaggtcaagaatcaaagtgagtcagagtaggaaaagccagactcaagcataacagaagggcagagcctgtcaaaccccaaaattaaagggtaaatttcaacacaagtagaagtggttcaaaagctaagggcatcctcatagttcatgaaaagcaagtattcacgcaggtagcagactctaatctgcttcaagccaatgtgctattctcttcgtgttatttatatccctcagaatacctcaaagttcccaagagcagtcagtatttaactctaaactatatcatctatatgatatatttattatatataatatatatattatatgtattatatattatatatttattatatgtataatatatattatatatttattatatatataatatatattatatatttattatatatatattatatattatatattatatttatatttattatatatataatatatatctgtttattattatatatttttttgagacggagttttgcttttgttgcccaggctggagtgcaatggtgctatctcggctcaccacaacctctgcctcccaggttcaagtgattctcctgcctcagcgtcctgagtagctgggattacagacatgtgccaccacgcctggttaattttgtatttttaatagagaaggggtttctccatgttagtcagtctggtattgaactcccatcctcaggtgatctgcctgcctcggcctcccaaagtgctgggattataggtgtgagccaacgtgcccagccaactatgtaatattttaattgtgtagtgataaccctcatcaaaaggagtattcattatggccagtgtactctgcttatttaccactaaagcttaacacaaaattgttgaaataaacatgcatattgaagtacttagctagctattgaggcaatacaggtttctagatttactcattgttttcactgtacacacatgtcatgtgtgtcatgataaacccatgtgtgtgcatatattgattaaatattatatttctttttacttttattattattattgagaaaaggtctcactctgtcgcccaggctggagtgcagtggcacaatctcggctgcctgcagccttgtcctcccaaagccctagaccctgtaacataatagaatatgtatgtttctaatttgtgcaatatggaagcaggaatactacatagaactgtcatcttttcctattgcatttattttggtgtggaaaaatctaataattggcttcagtcagtaagtctatttcattcaagaatatttaaatataatccaaaccatcttagatacattttgtgatacaagaggatggtatcttctatttggaaatataaaatcccagggtctcacagtttaagtatactttccaggggtatgtataaaacaagaatcccactttacaaagttaatagaaaaaaaatatgctaattggaaggagaggcttctgattgaggataaagtggaaattttcacatactgctaattacactttaatggagtaagaaaaaaagaattggaaatagtaccctataaaacttctgaaatgaaattacagtttctctctctctctttcttttttttttttcttgagatggagttttgctcttgttgcccaggcgagagtgcaaaggcgctatctcagcacactgcaaccttcacctcccgggtttaagtgattcttttgcctcagcctcccaagtagctgggattacaggcatgcaccaccatgcccgctaattttttgtatgtttagtgacccaccacgcctggctgtctcctctttttagaattaggagaactgatttttttcagtgctaaactggcactgtcctatgttttcaagaaagcaatatggtgaaatggaagagtctggatagcatgttttgttagctggtgtctagttctttaagttccatgagtctattgtgtcttctttacatctcaaaaagaagagagaagaaacctgcatctaattactgaagcagtttcattcagcaaatgtaattgcatcgcaggcacatctcaaattaaaaatcttgatcttggtctctgtcatttccattttaaactgggactgaataacctgttttgccactcaaaataatagccagtgtctctttcttattaaaatatgtgatcttttgcttgattacctaattatgtcacctgcaccttacgtgaggcagatagaagagtcttccagtctgccagagcagatctaccaaactagactgcacatacaaattacctggggatcctgataaattacagattctgagtctgctttcaaagagggcctcaagtcaagctgatggtattagtcccaggatccctcactgagtagcaaggtcttagaattaaaaagtgtgcaagtataaggccaggagcagtggctcatgcctgtaagcccagcactttgggaggccaaggcgggtggatcacctgaggtcaggagttcgagaccagcctggccaacatggtgaaaccccgtctctactaaaaatacaaaaaattagccaggtgtggtggcacgcacctgtaatcccagctactcagaaggctgaggcagaagaattgcttgaacctgggaggtggaggtagcagtgagccaagatcacgccactacactccagcctgggctccagcctgggcaacaacagcaaaactccataaaaaaaaaagtgcaagtttataaacatggaaacgtggacaattgtaagcaatattagagaactgtagaaaacaattttttaagtgatatgtttaacctatttagaataaaacccattagggtcctaggaatttctggaactgccttacttgtgagaaacatgatcctaagatgcccatttgtttatcagtacatcaattttctccttcttaaattggtataattattttcttccaagaagcctagcacacttttgttgttgtcattgaaagagggcatataagggttatggctgctatttggagaaatgcattagaaaataaaaagcttgaaaaagttgtattactgagaaaaaagttgaatgaaaataagaaagattaaattgaaataaataatgaatcagtaaggtatgcactgttaaacacttgatgggatttcccaagtattgacatgctgataacttgaaataagaatgggagaaaaggtcaatctgaattcttaaaatgttgaaggctgggaataagaagtaatatatcacagaatctgatagaaaaatttttatttattttatgggagaaaatgggagactaacagacaataggaataggaaagaattaatagaaatagcaaaaagaagtgtatctgcaattattaatataatacaagaggaaattgtgtagagatatttaaagaaagattgatgaaatttagatttatggagaaatatcctaataaaggcattatttataatcaactgttcataattattatataattctgacagtttttaggatataaatgtaaggcagaatgatctaatataaaatgtataaatgggacaacatataattttgcttaggaaattgaataaataaagtagtgatttacgatttgcattaatataaaaaaatttaaaatggtttacatcttgtttgaaatggatgataaacaggaaaagagtaatttagtacattgagtaatttagtacattggtcaccaaagaaatacaaattgaaactataagatgccttctcccatctttgtcagatttgtaggtataaaaacagtagtagttgtattggttggagaacagaaagatgacactttcatatgcggctgattagagcacagattggtatattatttctgagatgcaatttgaaaatatgtaccatcagcctcaaagatgattatgaccatgtgtcactactttcttggaaatcattattaatgcatgtatagattgatgtttactgtagtattacttaacataatgagttgagtacaaccttcactcccaaaaaacatgaggtaggggtgaattagttaaatatacaatcacaatgagctatgacaaaatgcagttacttaaaagcacatttataagactattaatggcaataaacatgatttgatataattttttcaaaaattaggggaattctattcctagcattgtgacagactaaatttgctgaatcactatcctgctatatgaaatctacaaataccagataaaatgtacatgtcatttttcaaaagtatattactgacttgaatagaaattaaggtgaaccacataggccaagcataaggagaatacataaatccagagaggtatgcagacccccaaaccagaagcttccataaggacagtcctggccctagtaccctgagcttcaatttttatgaccacctgggatatgggagagtgtgagacaaaacctagtgcctgcccagtatagcagtcttacaggagaaaactgctgaaagccagagatatgaaggactataatttcagtgaaaggataaactagataaaaacctgttcctcagggggagacaaccaggaaattttcctgcctcaaactcggtgctatttagaggaaaaattagaaggccatcttcacatgaatttgtggtttaaattttcactgtaagtataattttaaaaaaacccacacatgaaactgataatttattttatagttatcccatgttggtattaccaccaaacacaagacgaaggcaaagtgtctttggagaaacccacattcagcccatgtctcaaagaatggccacaggtaaaatttcatccaaaatgagaaaaaagtaagactcttacaaaactcatgaggaaataaacatcatgagcagaaacagaattatgcccataaagatttcagatattaggatgattatataactataaaagctgtgtttaataggtttaaaaaatcaatgaggtgtgccaggaatataaattgagacagtgtatgtatcttatgttaagcagattgaaactgaacttaagagatcttttagaaataaaaaatataatgaaaattaaaaactaaatggacaggttaaacacaatattggatagaaccaaaaagaaaataagtgagttggaagttagactaaacaaattatgctgaagacagtacagaggaggaaaggaaaatggataggtgaaatagaggttgaaaaattagagtatctaatcatatctgcaaaagaaaaattgaattgggggaaggttatatttaaggttatatttaatatctgagggcttttcatcattggaatttattaatgttcaaggaaacctggaaagttttctaacacattaaaggagctttaattataagttccaaattcttcttagaagaagagaaccagcaggcccagacatttttactggtgagttctatcaaatgttttcaagaaattgattatttccattttataaaaacaactccagaataaaaaaaggtccatttgtttgttcattttatgaggccagtacaaccttgataccaatgttatatgagaaatgtgtaagacaggaaaattacatgccaactttcctcatgaacctaacggcaaacattttaaattaaaagttagcaaattaagtttagaaatctgtaaaaaagataatatagtatgaaaattgtgtttgttccatgaatgcaaggatttctaacaatagaaaaaaaactatgtataattcatcacattaacaagttaaaggaggaaaagcaaatcatcattgtagaagaggcaaaaagtgaattcaataaaataaaatatttaactttgacaaatcttgtttagcaaacaagaaatagaagagctttcagtgtttgcttataaatcagaaactattcttcgtctttcaagcagaggtgatttaatacaggtgattgattacacaagtgatggaagccaaaccaggcttggtgagtcagcagctcaagagcaagaaaccagtactgcccctaggactagaaggatcatggaagaaggtgttattatcagagccaaggggccaggacttcaggcaggttgctagagctaatgggaattgggtccatggagggaggggctatctggtgggaagcagccctgcagagaagaggcaggcttttatggcatctctcactggatagcctactgggaaaatggagggcaaaggagactgggaaataaatgttattttcctgaaacatagaacagagttggagagtaatttgggagggatctgggggcaaatttgtcaggacccaagacatgattaaagcaggcagggaaaagagatgctggtcaaagcaggtggcctttgctggtatttcaaagtcctagttttaaaactcagaggttttaaattattatcttattactaatcagatattttatacatatttaatatatttatatattaaatatttaattataattcaaaacttttatgtacactataatctcattattgttttctatactattatatacaatatacaaatacagaaatacagaaatgtacctcagtttgaaagagaatttgaatatgaggcaaaaaatacccccaaattatagttacattacaagaattgaatttaagaaggaagaagcaaattgcaagagataagaccaagcctctttagtaatgatcattctaaatccaattggtataaatttagagatgcacaactggattgcagtgtaactaagaaagtttgtgtgtcaaaaaccatatttatcctatgtgaagaaataatagtttcataggagaaggttaattggcatggagtctgtaaaagagaagtttggatagatgatcgagctatatatttgtcaaataatatctaaaggtaaaaagatctagttcacagaggcgaatctctgattttttaatttgcattaacagaaacaacattggaagggagtatattaagattttaatagtgactatttctgccaatggtttctgttttattgtttactattttcggtatatttccaatgtttcttaataagtgtttattatttaaaaaatgagaaaacagcaatgagtaattcagtaaaataaaatttttcaaaattgtgactgctatgattatgagccaattatgaaagaaagagacacagatagaaatagggtgaccaatctttcaacttactcaggaatgaaggattttctggatgggggatttttgttgctaaaatcgggacagtaggggacatattgggactgtggaaaaagcctacagggatttatttcctaactatgaatgtctatcttggtctagagacgactgttctcataaataggtagagtagatgtggtatttctggaatgagatttaacatctttacgtagcttgccctattaaaagtagacaaatgcttgtgagagaatatcatatacttttgaaagctaatgtcttaactaatttgctgcaagcaaagctcttgaagactgtgatgtaacagagattcctaggtatcagtgaagatacggagatgaaaaagggaagttgaaaaaagaagctgagagataagcatggaaatcattttccaacctcatttttccagtctccattttcctgtattgagaagtgaaaatatgttttctagagataaagttctagaaatgaactctgacatagatattttaaaaccaatttcagaaacaaaataatatgtgaacctagagtagttgtaatttatgtccttttgtttgtctttatcctgtagttaagtttcccttgggatctctttgggaaaatggagtactgcattttacaaggcaggacttgaattttctttcttttccttctttctctctttcttcctttctttctttccttttcttctttcttctttctctctttttctttctttcttcctttccttccttcctttttcttttctttctttctctctttctttcttcctctctctctttttctcttctttctttctttctttctttgttcctttctttctttcttcttttccttccttccttccttcctcttcttcctttctttctcctttctttttattttttttgacatgatctcactttgtcacccaggctagagtgcagtgatgtgatcatagcttaatgcagcctctctctcctgggctcaagcaatcctcccacctcagcttccagagtacctggggctacagctgtgtgccaccacgcccagctaaaggacttgaattttcttacatatcttggccctatagagtggttctcaaccttggctgcacatgtctattacctgagaaaagttttaaataacctaatactcaggtcacaccctagactttaggggtgagacaagcattaatattttttaacactcttagaattaagagccactaatattgtagcattgcaattcctataaagagaacagatgtgagtcaatttgttacagtattgttgtattcatctgttttcatgctgctgataaggacatacctgagaccgggcaatttacaaaagaaagaggtttaatggacttacagttccacatgggtggggaggcctcaaaatcatggtggaggacaaagaggagcaagtcacatcttacatggatagcagcaggcaaagagacagcttgtgcagggaaactcccattttaaaaatgatcagatctcatgagacttactcactaacacaagaacagcacaggaaagacccatcctcatgattcagttatctcccactgggcacctcccacaacatgtgggaattatgggagctacaagatgagattgggtgtggacacagccaaaccatatcaattgtcatcactcaaggcagatgagtatatagaaagctatcagttgtaaggaattggactaagtttaagagaataataattaagatagaacaaatgtttggtcctgcttaagggctaggatagatgaggcacaatagaatcatgtggggagctgtaaaaatgcccaggccctactctgtgtcaattaaatcagaatccagaatctctgcttgagtgtgtctagagtattggtcaaaggaaacagtgattttgatgtgcagccagttaagagctgatatcctcaaggatcatgatgtgacacagctgtttcagaagggtaaatctccatactcccactttagaagaaaagaaaagacaaaatgacaaaacaatcaagcaaaagggctggaagagctggtagataacagggtgtcaacttgaattaattcagctctttggtaaagattagctggagtaaagaaattccagttagtcaaatgggatgaatgtccttttatggaaaccatatcatgctttttgaatgatctgagaaagactggaagcattagaggtgaagtatatccatttgctcaatgggagaagattttgttttattttatttacataatgtgatatgcttggccatctgcagtagtgcctgaaaggggatgtaaaacggaaaatgtagtcaatgagactgattaataaccctgggtagaaaaataggccaagtggaaaaacttattcatataattgcttcattttgctgactgcaaaaggatttgttttggaagtgatttctgctctttaacctagtggattgatagatcacagaaaggtcttagaaatgacattacgtaattttgttcataacatgaaattagcttgaatcaaaaaatgtatacctttttttgtatctaccttctaagacatttgtcttgagaaattaatgattctacaacataaatagtcattgtgaaaggaaggaaaaagataacagagggctttcataataatcatggactcaagattatctaatttaaaaagacatatctcattttcctttatttaaacataaaacaaatgagagaaaacagaaatagctcataattttatttatctgataaaacatgctgacataaaaatataattcatgcacccagtaagaaaatcaaaaaattaaataaaggtaaaaatgaaatataaaattctctttcctctagtctcttacccccagacatctagaatctctccttaagataatcactgttgacaatttcttgagtacctttttaaaaatgaccttaatacacatcccccgtatagaatatagatcttaaacaagttagaaaataaaattttatcttttagtattacacaaaaggatgttcagaactaagctttgtatttttttttttctagagatgaggtctcactgtgttgcccaggttggtctcaaactcctgggctcaagcaatcctccagcctcagtctccaaaagtgttgggattacaagcatgacatgaagtcttgcctggcctaggctttctatttttgtttaataatttaccttcaagatattcttaacttttaacaactgtattgtataaatatattttttatttaaacaataggctaccaataacattaataacatatcttggtttatgtattttacaagattctccaagtgataaattccaacctgaaaagttgctatagaacatatgaatttaacattttttaattgctgcgatctaatatgatcctaaaacatggccctagtttatattcctatgagaatgtctaatacctacactcttgctaacattgactgctattgcattttaaagactaatttgattggattgatgttgaacatcttctgttactcctggccattacatttctttttctacctattaatctcccttgtataatattgcattattcgtcttttttgtctcatttatcgacaaagattaaagttattggcagtagtgaaaatggagaaaaaaatcaaaattcaaatactgtagagtacaatattttggagaataatttgattctatatattgaaatttaaattgtctttaatctttgacccagttattctatttctagtaatttttctacccaaataataatacaggaaaaaaacctttacagagattattcttataatgtttgtgatacaatatttacaggcaacataaattctcatccagagatcagagtaaatattatatagtatatctgtagaatgaaatgtaccttgctgtttaaatgagtaaattagttattatcataaaataaatgtcatgtaaagacatttattttatggtgtataaaattagaaaaacaagttattaaaaataacatgattttttgtaaaatgcttttattttgtttttaattgacataataattgcacatgtttatggggtacagtgtggtgctttagtgcatgtgtacattgcgtaatggtcaaatttaaaaattaaatgtattgatagaaaaagtgtttggatatttgtatcctaaatgctaacagtgatgatatctggaatgtggaactgctggtaatttttccctttttcttttagagatttttgtacttatttttaataataaacatatactaattttataataaaaataacaatgaagtcctttccattttgaaaaattaattccaatagaaaaatattgtacttgagccactttccagggttttcttattcttagtgctggtataaggtaccagtgatattatattttcagatatgtttggcttttctgccttatggttgaagatgagcttaggaagtattgctgcctaattttcaggcttttgagccaatgcttggtgcacaaaaagcaccacatcaactttaaacagaatattctgcttctttagactgtatttcctactttttatagtatttattagcgccagaactctgtgactgtttcccaaagaacaagagagaaagatcaaggaaagtgagaagcaatgaaactagatttaattaatactctggcttgtcagcagccagatttgtttgttgaagaagttgaacctattagcttaaacagggattaactctgccaactctgacagagcatggacaattaagagtttattggaaattaattgaaaataatacagtgttgtgaggtgagatgaagatgatttcctttaaggaaattatgccaagtgttttgaatcagccaaggataaacaaatgcagactatcatttgatggaggtattataaactgataacatgattcgaagtataagaatggcaaattgtgaagaatgaatgaaattacagagataaatagcaaaaatgtgaaactaaaataaagaggaacagtgagtaaatggggttagctgagaatatggtttaacagggcatactctattcatttatgaagaaattttaatcctcaaaatgctacttgtcttagtctgtgtaggctgctgtaacaaaataccacaagctgagtaacttataaacaacagaaatttcttacagttgtgcaggctgggaagtccaatatcaaggcagattcagcatctggggtgaggttcacccttctggctcatagatggcaacttcctgctgtatccccatactttggaaggggccaatgagctctctgggatctcttttataagggcacaaatcccattcatgagaatcttgtcctcatgacctaatcacctccccaaggctctatctcctaacacgagtagtttgggggttaggatttcaatatacaaatttggggggacataaacagtcagtctgtgacattgccatttcatcagtaagaattttcatgaactcactattaagatttatgtttaggttttttatgtggatgttctcactttataatattgtttgtctgcatagtttaaagaaaaggacaatgcccaattagaacaggaggtgtcttttgttggccagcaaaatattttaagatgcctttagtgtgaccctacatagagatcatcaaggtaacatcattttgttcttgttatagatccacatgtttcactcaagatcccagaaagaaaatgtatgaaaacacattgaaagacaataatccatccttacaatgctagccaatgtttattattgctttctatgtgtgaggaattgtgttaaacacttaaaaagatgttatccctcataattatcataacacctgaagaagtaggtggggtgattttctccaatttagatattataggaactgaaacacttgcccactaaacaggcaattgaaagagataggatttctatagaaaattgccagctccacagctagtgttcctattctcatcattagtgttcccttagtggttttgatattacacctaatactatttaatacaaaattaaagcatccaccctattctgggatttactgtcaagaatagagcactgagcctgataaacagtatccactttggaatgcatgtttctatccagctacttaatatgacataagttcattggacattaaggccagatttcttgacatgctttaccctcaaattaacaagtttggcttattcaattgtggacctttaacccttaggccagatagtatatgaggcctagagtagtggaaaaaggtaactggatttacaaaatttgactcttcaaattctgtaagaattcaatatattgaggaaagtttaggtgcatagtaaaattataatttcatattgttgcacagactcaggcagatgaaagagactccaatagtggtcaggtagtacccagacagtcagttgattgtctctgtgctgaaaggatttaagaatgaagaagagtttgctccaatgtatgtttcaatatctcattgttttacaataatatttgaaataatacctaggaacccaacttacaagggatgtgaaggacctattcaaggagaactacaaaccactgctcaaggaaataaaagaggacacaaacaaatggaagaacattccatgctcatggataggaagaatcaatatcgtgaaaatggccatactgcccaaggtaatttatagattcaatgccatccccatcaagctaccaatgactttctttacagaattggaaaaaaactactttaaagttcatacggaaacaaaaaagagcccgcattgccaagtcaatcctaagcgaaaagaacaaagctggaggcatcacgctacctgacttcaaactagactacgaggctacagtaaccaaaacagcatggtacttgtaccaaaacagagatatagaccaatggaacagaacagagccctcagaaataacaccacacatctacaaccatctgatctttgacaaacctgacaaaagcaagaaatggggaaaggattccttatttaataaatggtgctgggaaaactggctagccatatgtagagagctgaaactgggtcccttccttacaccttttacaaaaattaattcaagatggattaaagacttacatgttagacctaaaaccataaaaaccctagaagaaaacctagcaataccattcaggacacaggcatggcaaggacttcatgtctaaaacactgaaagcaatggcaataaaagccaaaattgacaaatgggatctaattaaactaaagagctcctacacagcaaaagaaactgccatcagagtgaacaggcagcctacagaatgggagaacatttttgcaatctactcatctgacaaagggctaatatccagaatctacaatgaactcaaacaaatttacaagaaaaaacaaacaaccccaacaacaagtgggagaagtatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacactttcacactgttggtgggactgtaaactggttaaatcattgtggaagacagtgtggtgattcctcaaggatctagaactagaaataccatttgacctagccatcccattactgggtatatacccaaaggattataaatcatgctgctataaagacacacgcacacgtatgtttattgcggcactattcacaatagcaaagacttggaaccaacctaaatgtccatcagtgatagactggattaagaaaatgtggcacatatacaccatggaatactatgcagccataaaaaaggatgagttcatgtcctttgtagggacatggatgaagctggaaaccatcattctcggcaaactatcacaaggacaaaaaaacaaacaccgcatgttctcactcacaggtgggaattgaacaatgaggacacatggatacaggaaagggaacatcacacactgtggcctgctctgtggtggggggctggggggagggatagcattaggagatatacctaatgtaaaagatgagttaatgggtgcagcacaccaacatggcacatgtatacatatgtaacaaacctgcacgttgtgcacatgtaccctagaacttaaaatataataaaaaaaaattaaaatattctgcagtcacagtgactgtcttggcttctcttaatttatgaggacctttgtcttatagactcttttttaaaaaaaaagatggggtcttgctatgttgtccatgctggagtgcagtggctattcacaggcttgatcattgcatactacagtctggaactcctggactcaagtctcccagtggctgggaatacaggtgagtgcctaccacacctagcctgatttacagatttttgacatctattatagttaaatgtattttcagcatttgcatattaaaggaataatattgatgcttaacttcattagtgatcagggaattccaaatttaaaaaaatttttttcatctcttatagtatatttaaaaattcattgctgataaggattcagggacgccaacattgtacattggtagtgaaaatgtaaattggaaactttctgtaatctgacagtaattatttttttaaaaatccttttgaacttgcagttctacttttgggatttgaatttatggaaagtaaagtgccagtgagaaagaatattgttgccccttgaacaacatagggttaggggagctggcctcccacacagtgaaaaatccgcatacaacttttgattccccccaaactaataacctattgttgaccagaaggcttactgataacatgcgttacatttaagacatattttgcatgctatgtgtattatatactgtattcttacaataaactaagctacagaaaagaaattataatcaagaaaattgtaaggaagagaaaatatatgacccattcattaagtggaagtggatcatcctaaaggtcttcatcattgttgtcttcatgttgagtaggcagaggaggaggaggaggagctggtctttgtgtcttagggtagcagaggtggaagagggtgaagggatggaaggggaagcaaaagaggcaagcacacttggtgaaactttacaaaaatacatcattatttctgtctattttgctttttcatttctctaaaaacctttcagtgtagtacctatccgtcttccaccatttgctttagtttcagttcctgtatcatggaacggtctatgtcataaaagaagtcaaaagtagtcttgaataatcaaagctcttttgccagattgttgaatgccaatttgttttctggcactgcttttcctatgtcttcttcctcattatctggcactggttaggaagcactcatctccatgaagtcatcttttgttaattcctctggtgtggtgtgtattagctcttaaattcctccaagatccatatcttgcaacccttcactccacacctttttttcccttcatatccatacttctttccatggttttctctaaattgggtttgtcgtaattctgtagctatgcacaaaatctggacacaaattgtacttttgtccagcaggaatttattgttttgagtttcatggttttctatatcaactgatgacatcttgaaaggtgtaagccttccagacttccatgatgttctctgtattgggtttctcttttgcaatgttgacaaacctttccatagagtgccatatgtagagccttaaaggtccttatgactcccttatctagaggctgaagtagagatgtgtttgggggaaaaggagaacacttcagtgcctttggtgttgaactcatggggttctgggtggccagggggcattttccaattaaacaacaacaacaaaaaactttaaaaagcagtcccttactggcaaggtacttctgacttcagggacaaagcactgatggaactaatccagaaaaagcattctcatagtccaggccttcttgttgtacaaccaaaagactggcaactagtgtttctcttttccctttcaagactcaggggttagcagctttatagttaagggcagccctgatcataaacccgactacatttgcacaaagcagtagagttagcctatcccttcctgccttaaatcttggtgcttgcttctcttccttactaataaatgacctttgtggcttttatttttccccctggaatagggcactttcagctgcattaatacctattcaggcagatatcctttctcctcaatgtttttcttaacggcatttgagaattcacttgctggttcttggttggcagaagttgctactcccattatcctgacatttttaaaaccaaaccactttctaaaattatcaaatcatcctttgctgccattaaattctccagctttagatctttcatcttgcttttactttaagttgtcaaataatgacttcgctatttcttgaatcaaataagagtctataggtatgtctttcttatagcaattctgtaccccacataaaagctgcattttgaatatgagataagaaaggacaaggttttcatgcctgttggcatgaaatgaggccttatgaatttctcttttttttttttaagggaccttacactggattcatttattttgaaatggcaggcagctgaagaactcaatctataggaagcaatctaactttttctcataatgtcacaacttttctctgcttcttgggagcactcccagcatcacttgtggcactttgtattggtctcatggtgttattcaagatttatagtattacactaagcacaatgaaaagagaactgtgagagaacacactatttacttagatacagaatttactgaagagaccaagtgctcatggcagatactggcaacatgagctcaccacagtagcaacagggggtggctacaaaattattataatagtacatacactggaaagtagacgctggagaatattccaaaagatgccagggttggaggggagtgagggttgaaaaattattattgggtacaatgttcactattggggtgatgagtacagtaaaagctcagacttcaccactagcaatatatccaaataacaaaacaatcatataataaaagtatgcttgtacctagcacatttataaaaataaaataaaactaattatttgggtagtacagtatgtgctatagttaattgtatgcagttgtggtttaatacagcatctttatgtttgtttatgtttctcttgactgcaaatagtgacttgtacggtttgtgtgcatacattttgataagttttaactttttataatagatttgtgtatattttatggtagtaaatgataaaatagattaacatatacatatactttatgcattcaggatgtacatagctttttcttaatttttttcttatattctaggctatgcagttagtctgctagttttttcaattgcaattctccaaaactttttctgatatatttatttttttaaaaaaataccagtgtaggcggacctgcacagttgaaacccatgttgttccaaggtcaactaaaaaatctgaaatctgaaatgcttcaaaattggaaacattttgagcactgatatgatgccacaggtgaaaaatttcacatatgacattatatgactggtcacagccaaaagacagtcaaaattttgtttcttgcacaaaattttacaaatacataaaattaccttcaggctacatgtatactatatgtagggaatgtaaataaatttagattgggtctcattcctaacatatcatgttatgatatgaaaatatttcaaaatttgaaaaaatccaaaatctacaatatttttggtcccaagcatttcatataagggataccatactccagaatgttagaatgtttatggctactttgtttgtagtacagggggaaaaaaatcatgatgagtctccatcagtaaaaagatagtttaaaaacttgtagaatttagtcatatacatatatttacacatgcatatatgcacacatattatttttctctatatagagaaactgtgcattcatttaaagtgatatttcctctttttgttaattgacttggagaaatgttcatactgtattgataagttggaaaatcagtttgtttacatgaggtgaagtggaaaagttaaactacattataaagtacattataggcttttcaaagggcaaaaaagtgtcacctgagatgaggcaatgaagtgctcatggccattcatccctgttttacaccaatagaaagaaaagtttggaaaatgatggatttctcaataaaatttcaaggaagtagagataaatatgttactgtactaatgtattcatgtcttcttaagagaaatggaactccaaatttttagaatttttgaataggaatgatagaggaaagaaaacagaacactagtgactccggcattgtctgaagctgaggactgggctgtgggtaaccaacaggtgatattactttagcctgaataatccagacgttatgatgttttggcctctgtgtccaagactcttgtagatttcttgtcaggccacaattctttgagtgagagtaatattttttcagtaggcaaaaatcccttgaaagatcaatccagggacatttataataaagataggattagaaggtagactttaggctagggttagggttggaaaaatcaaaacacgttgttctctttagagtgagaaattggtttatcccagactttgaaagataatataatctataaccctctggttatgggaaagaagagacctacatgtggccatcttgggagcaaggcagagagcaggctggaagatcttctaggatggatatggacttgtgaaatgcagtagttaaacaaagttttctcagagttacatttgccttccatcattcctgaacactcatgtcatcatgaaattagaagagctgatccaatactattgataaggaaagagactctcctttccccaaagcgagagatagcagcaataatcagataatggcccagaagatggatgatcatacacacggcttgtgtgaggcttatggaagataaaacaaccacaatatttcagaaatgtttatatgttgtttacagttctaccactacaaagccttctagaatgtgagacagaatggtgtgatgattattcttagtataaccagattaagtaagatttcacaggtggagttaagaattaagaatttttgattcaagagtctcattcaccctcttccttctttgttaatagttctgttaggatctgcctttaatttgtcttttcctttagggcgctcaaaacaacacaaggattaaatgcctttctatggtcaaagttctctccttatttgccagttctttttttcatgtcccaatcataatcttaatggtatcgttgatcactcaagcaactaaccctgaagactgcccagtcgcaggagccaatacatctttttatgtttaaactcaatcacttcaaatgttgatcttaccttgtataatagaaattagtcgtagagactgtggtgggatgagatagcattgcgggtaatctggctcagctatggctgagtggaagaaacttgcatcaattatttatggttaatacagagtatcctagatcgtagttgtggactgaatacagacattcagctccctcccccactgagctctcataacaatgcagggactggaaagaatgtcagcatatgggatgggagaatgagaagacgggagcttcttgggcagatattacgtagtgaggaagcagtgggtgagaacattcagtgagagaccacaatgtaaggagaaagtctatctgacgagtggaagcagagactccagactcagaacctttggtacgaagagtaactacagcaaacgggcaaagaatagattgtgaatttggaggttatgtgcttccttctggcacatgaaaaaactcctaaagctttttgtgggtccaaaatgaaataaaaatctttccccattggtatgaaaataagttaattagcttttacaatggtttgtttttgtgttactagtttccagttgtggctgtttctctcagtttctctctgttttggtttgtttgtttgttgctgttttccttctcttaggaaactttggcagataattgggcacagaaattggtcattttttaaacactctaggttagtgattctcatagtccctagacatcggtatcagtattacccggcaacttgttagatatgcaaattctcaaatcttacctactgagtcatatactgccaagtgagccaaggaatccgtttaattaggctttgcaggtggttctgatgcacactcaagttgaaccactgctgaagccataactattggagacaatcttgcatagcttgaaaaatggagagctctaactgttggtaaggctttgctttatttgtcttaagaaagcattaatgagaatagctttgtgtttctttgaagttctgggtgcttctgaaaactctaaaggttttcaagcatttaaatttctctagcccttttctcaaacaaacaaaaaaccccaaacaaggaaaatctcatagaaatataaaaatgagttaaaataagttgtgaggaatattctatacatcaacagtaaagtattactcaacctcaaaaattacatctctaccataatctataatctgactggataaggactataaataaatagcatatgaaagtctacaataaagcagggagaaaatcatcactggctccgaatttgataatgacttcttgttgtatgtatgtaaatatcttctgaacaaattattgtacattttcctatctctggagaaaattaatgaattaggttaaacaatttcttaagtttaatggagcttctgttttccttggcttatgtatactagcacaggtaacttgctgaactgcagctcagaagaaaaaatctatagagaggtttagttctgaggtgaattaatggactttgttgctatgtcagaaggcgagaagcaagggaaggcaggcgggtaagagaatcgcataacgcaaaggacttcagtgcttcagaacaaaattgaagcgtttcaaaaatttgactgaagtaaagttcagtaatatttttaatcatgggaaatccttggataaatgtatatggtttgataattttggtttaaattaattatgttttttctctgattttatcacaatcttagaattaatgttagcatatttttctggtttataaaatattttaacttaccagagctttctagatgtcccctactcgatttaaggctcagctgaattgaattattaaactagtattttttaaaacatttgttcctgtaacttgagatggggctacaaataattatactgtataggtaaaaccacacataccctacctggtaaaaaattcaaatttcatatgtaacacaattttcatgtaaatttttatattttagtataaattctctgcagtgtgtcagtttaaaatgaattttaacatactagttagctttatgagcttggctaatatttcattgagataattagtgaaaaatctttggataagtctcataaaatttttaacatatccttgctgcatatttttacacattatagagtggctatcaagtaggagaatgaacagtatgtaaaagtacccttagttctgattaatgcacatgttcttttatactactttaagaaattaagtcagtttgagtatttagaaaagtgcatgcaatataattaatgtgtttttgcttatcaaggcaaagagagtaattttgtctaaaaggcaaattgtagagttttgctagaatataaaactgaattttaaaatacaaatttaagggcatacaataattgtagaatatctgagggaagtaaacttcatttgctatagcttataatagctgcaaataatgagtttaaatgagcaataaaacgtttataatttttggactaactttactcaatgttaattagtttgggcataaaacataaaagaacttttgagtcttttagtcaatttgttaaatggatggtctcaaaaaagtcatattagtatttgggttacctttttgataaaataataaatcaatctccatatattagcctttttttttttttgagacaaagtcttgctcttgtccctcaggctggagtgcaatggcgccatcttggctcactgcagcctctgcctcccgggttccagtgattctcctgcctcagcctcctgagtagctgggattacaggcgcctgccaccatgcctggctaatttttgtatttttagtagaaatgggatttcaccatgttggccaggctggtctcgaacccctgacctcaggtgatccaccctcctcggcctcccaaagtgttgggattacaggcgtgagccaccactcccggccatatattagttttttagcaaaaatttaacacttgtattctccacagtgtcctaccggattagatatagctctcctggactaaattgtttctcacccacagcaatattgccatccgggagaaaagagatttatagtagtttactttgtactcctagaaatcctttcaagaagtataaaagtgaatacatacatatttaaatgataaacatttatctttgtgataaaatagttaagtttccatgtgagtcaggtttaccacatgagtgatgaaccagctttaattaacaatataaccattctcctctgtcactgtaggctgttctaaaaaaagaaaaaagtttacaaaagccttaattaccttatgctatttggggagaattaagcaatgaatggagtgttgcatttaacaggttatagaaaatttttctgtgtccagcatataatcaactactaattttcagactggtttggcacaatatagattttctgccactgaatagaaactaaaaaatttgaaagtcagaaaattatttcccaggttctgaaagatatcaacaaagatatttttaattgactatgtatgattattgatttgagatttaatataccatgtctatgagaattctttgtaatacttctgcagtgtaatttgctacataatgaaaattcatttttcataataaatagttttcagaagtcatgttatctttcttgctcccagcaagtagctctatttcttggccacattgaggaatcaaaatctaatgtaattcttctaaatagaatagagaacacctagagtcgctgctcctatgacaaatctttggataacaactctcatgtgcgtaagacattttctgatctcttctgtacttcaacttgtaaagaactttggacattacagtcagaaagtctgctattcctacaaagacaaaaggggaagcctctaaattccctgagtagtggggataattagctttcatactcatctgctgacccctgattatcagaagacatttttatctctttggcatgccccatcacctgctgtctgtctccaaaagacctgtagatcagagcaggcattgtaaggcagggacagttcctgaaatttccaattaactgatgatgggaaagctcagaaacacaaactctggggagtggctgcctggtactgctaatactcctgctggaaacaggggcacctgggctacaaacaaacgtaagactttggaagaaggtgcgttaacttaattctgcctttcacatgtgagctcccaatttcccttgtggctatgagccacaagggcccaaattcaatgggagggtggttcgggtctatcatgacaagccaggatggaggagacagaggtcagttattgggagcccagattcttgccctttagaaacatgtgctgtagcagagaggaacccactacagctgggatcctggactgacacagcgagtgggtagtccatccagggtcacctgattgatagcaggcccttcacatctgcagcccccacctgtgacactgtttttgataccatattctccaaatttaaccctcaaatccaaaatagtaaaactactgagatgttatttatgaatacagtatctctgggtttctcagatggctgctgggaaactccagagatcctcctcctagctcttaacatgaagatatattagaaataaaggtaatgttttgcattctccagatatttaattggctcaaaactatgctcaatatagtggaagctgctgtgtttttcaaggccatattctgagaaaatagcaataaaatcatcttaaattaattaaatgcaataattatgtatgattactgtggctatgttacaataattgtgcacttctcaggttggattcaggcatatttatgttcatgtacaaagactggtgcaataaatgtcaaccaactgattaaaaaaagtaaacttctcagttggtgacaaataataatatctactttgtggggaaaattaaaggccctggagaggtatcgggatgcactaattgttcttcatgtgttctgtcttttacggtaatcactgattaaaatttcattagatgagtatgtattacacctcaacagagaatgccactgtcccccattgtgatgtcgtttgctatggcaaaaaattaaccaaactttacagttttattattagcaacatctcctccccctatccccgctgcttttttttttttttttttagatggaatctcgctctgttgcccaggctggagtgcagtggtatgacctcagctcactgcaaactctacctctcgggttcaagctgtcctcctacctcagcctcccgagtagctatattcaggtgcccgccaccatgcatggctaatttttctattttcagtagacacagggtttcaccatgttggccaggctggtctcaaactccggacctcaagtgatctgcctgcctcagcctcctaaagtgttgggattacagacatgagccactgtgcccagccctcctttccctttaagcatacctaaaagcctctctacaaagcgccaatcagaatttgagtcatctggaagaaatatcaaaagagctccagtaataacggtagcagacactgttgatactattgataccacaggaaattgactcatggatataggcctccaagaataggctgaccttgtccccacagacaatattccaactatacgaagtaaatgagtcaggagttccaagacactcacaatgtagaagcggatgaattcatgaaagtagactgcttaactcaagaccagcacgacaagaggttgttatttaggattaaagggcctcagtaaggcaatttaattgaggttagtttaattttctactttaatgaacatgagaacaacccattttctttcttcttaatctacctttaatctccaattaaatttacaaattattaaatttgtaaaaactaaataaaacactctgaattcttagtgttgagggaaaaaataccttgcagaaattcttaatataaaaacaaagctaataagttgccaagaaaaacatacaaataattattttgtaaagaattgtgacatacaatatttggttttgtctattaacatacccttaattagcaatattggttaaatcttgcacaaagtttctttaataaaaacatttactttttgtgactatgtagttatttatattggttcaataagaatttgtcctcccttctacctgaatatattactaattagaattttttttttttttttgagatggagtcttgctctgttgcccaggctggagtgcaatggcgtgatctcaactcactgcaacctctcaatcttgggctcaagcacttctcccacctcagcctcccaggtagctgggattacaggcacccaccatcatgctaggctactatttgtatttttatagagacggggtttcaccatgttggcctggctggtcttaaactcctgacctcaggtgatctgccggcctcagcctttcaaaatgctggggttacaggcatgagccaccttgcccagccaggaagaatcaattttttaataaaaaatttatagctgtgctacaaattcaatttaactagacaagacaaatccagtaataagaataatttctatgtttttcacgcagaagcgatgcctataacatccttctaggaaaccaatctggtgcttgctctatggactatgcaatctcaggcttggaggtaagaaagaatgtcctttcttggcagagcagggacaccgagacattggatatcttttattaaaaaggatacatttgcattataaatactgcagatgaaatcaggtagaggtgaacggactggtttggtctgctctaaactgagctgttaaacatgtaaaagtaaatttaaaccacaagggctttataaatctatagatagacgtaaacttgtgagacttagtttattgtttcatcaaaaaaatactaggaggtcattaaatattaatcaacacttcttagatctgtgcaaataaaatggatcaaattaaaatgtaaaatcaatagtactgattaggaacattgttcagcaaatggaggtagacaaacatgtcctgtagagaaggaaacatgaccgcaagatgaagtgtaaaaaccaaagtgacatcggggcctgacaccattgtcagcccattcatcatgtcccactgctgaagaaacagagaaaaaaaaactctgcactctgacataaagaaacaataaaagggtctctctgtctacctgcagtcctccaaatgaataaaaccttgagcatttcctgagatttgctaactccttaatgaaaatcactttatccttgactttacaatgctgtttattgtctgaagatatgtcatgaactttctgaatataataaccatgataaaattgctgttttctgccatgaagagattaatataaaccctatagtcttcataatattgtttgtcttaaaaagttctatttttttaattttttgggcagttcttttgaagaatgacttcctcacatttctttgcaagtaaatgcctccttctgcttatttttccaacatgcttttgtttctgagcctttctttcatgctctatacacacaaatcagcaggagatagtacctgcagctgtatttggagtttactgcctcaatgttcactttcaatgaaagagcgtatttcttaacagaagaccagaaattcatgctgaaccaataaattgtcctctatagttctcatctgcaaggaggatttaaatatttctagctcagtagttcagccctgaagattatttcacccccactgctaatcccgacctaatctgtttttgtgttgttaatgctcctatatactagccaggtcagtaattctgtaacaggcttaatttcttaatattttaggccatgtgttaattttactatttcttagccattttttcctcaatagttttaaattgcatccctgcttactctcccttttactggacgggcttcctctgtttactaatacaattccccaaattgattcatccacttgttgaaatacctaattttaggccctgcactgacagcttgcctaggcttatacttgtgtttggtgttgcagtcttcagattctaaaaacaccatctagaccttacattacctccagccagggctattcccccagggcctgccttaagaagcagatttcttttcaagtttcatcttcttcccatttatttcatttcatgacagttagagaagctgtatactaacgtgacaaatggtaagttagcagagaaaaacgttatttcaggataagttcagggaaagctttttggaggaaagtcagctcacattagtcctgatgatggatagtgtatagagactacagatgatggaacgatgaagtggaaactcgagtggctacatacggacattccacatagaagcagtgtgagcaaaaccaccaagacaggaaatgagatggaattgataaggcaatgcaaataattcaggttatttagatcatcagtgttgggggaagctgggtttatgggaatcaatggttaatcagaatgtgagcaccattggtttggtaattcatggaagaggttatcattcaacagggggagtggcttctcgattataaacatgtctgaaggtcactgaacatcaaggctatccttcagttaaaatcttattaaaattatactgacctctgatgaccttcagagagctccagctagatggattgatgataagagaaattcgagaaggcaatggggcaaatctttgtgcaaatctctgttatgtcatatatctaaggcttctgctggatccagtgatttgtttgttctgactgtagtacaaatctattggaacaataaatctagttataataaatgacagagggcattgaagcagatgcaagaagcaaaatatacaggtgtaaagacaaactatattaggcctcccatcaagcttctctaatattttcacagcacagccctgcctgacttctctctatctggataggccccttctgtttgataaccagttctctgatgttgactacctgattctctagtcctcaagttgactcatcctgtttattgagagtgacatttttagactactaataatatttatatgtaagaaagaaactgggtttttatataaatatataatcttttcaaataaaagattataatcaaggaactgtaaataatagaaaaattacataatgtttccctatttggggattggttaaatgcaatattatagaagtctgaaaaaataatgactgtattacaaaagaatataaaaataattgaagactaggaattatgtctaccaactaattcagtcatttggctgtttattctcatttgaacagtagtggattaagaaaaaaacaaaaagactttcgacttccatcacagggagaaaaggatcaagtacacattagagaaagctgatggcaatgatttctagtttcagtttctattttctgtcaattaaccatcattttggtaaacagcctttttaaatgtcttttcttttaatttttaaatttttactttaaagacagggtctcactatgttgcgaaggcattggcctcaaactcatggactcaagtgatcctcctgccatagcctccctaggtgcatatcaccatacccagctattaatgtctttataaaagcatttttaaccctactggtctagctattgcatcaaataaatagctaattccattgaggaaggattagggactcacgagtgaaaataaatgttttatttggataatggctacaaaatctcaacagtcaaaataaataagagattaaaggcatgatgatgacttaaaagataaagttaggtagaaatgtgaactaagggaaatgactcaacacattcagcaacacaaaactgtggcctaaattcactctgacagttgttatgctatctcctgctgcccgagtaaagtaagttatgaacaagacacatgaaggggatcaggcagacatatggtcaaatgctttctgtgcaatatttctgtctccatattatcttctctctcattgcactttggacatttttattcttcctgcagatctatttttatgaagcaatgtgatttaaattaaaagagcactgaattctcagccagatatttgagttctagttgaagatttatcacctagtggttatgagatttggggcaaattacttaatctctctctttctttaccacttcatttgtaagttttcttgcctccctacaggactgtattggggatcaatcaatgttgagttgaaggctacatggtttaagttggcttaatggagaagtggtaaatcacttaaacgggtagaacaacacagtgtagaggatgttgggctgcatgaggaagtgtggaaaaaaagcatgccatgaaaatatcatcacaatctcacatttcttcatttatttgcacactctgaacacatgcatgtgataaggactgtgcaaggttctcaggatacccaggtaaaaatcaccacttctgccagtcttgactttgcaagcttgaggagcaggcctggagaaatttggctattaccacaccaaagttgttcctcacattccctttgacatatggtctcaggaaaaaatgaaaagagtaaaaaaaaaaaaaaagtccttcatttttgaaaggaaaagtcataattaatttctagaaggagaaagaaaaaaagagataacagtgtgtgaaaaggcttagaaaatgctagagcactacagaaagataatgtgagattatgtctaagagtagcttggttattttgcttttgttgacaaagtatacctccttcattttcatagttgtcataattctttccatgattttcttagtgggtttgtttaggagaaactgtattctttctttattcatctaactctccttaactccaaaagatgcttcttaggataacattttaaaaggatatacattatgcacatttttaatgcttctatacaggactgaaggccaatattaccatgataataaggcatgtaacaaaaatttgttctgcagagagtgagaaagcgtgagggaaaacacagtgcaggattctatgctgttgcccaagaacccagacaggcaagtgaaataatagagcagacatttcctgaggctgtggtcgatatgattaggagatagtgggtaaaaatggcctttaaactatatacacatgagaagatagatgtgaaagcccattgcaaaggcaataaaattatgcaaatataaaatatcactattaaaatgtatgatgaattgacatgccatgaaaacagttccagtgctgggccagaaatcaggaaacatgggcttttgatttctcaccattaaaatgaagaagttggatttatacccaagggtaccttgtgggctgtatggcttctaagtaactggtcataacaaaagggacacaatcaggtcagtttcaaaccaagaataaaatgggaaattaaagaactgaattggctactttctgctcaaatgattgttaaaaataaagtttaaaaaaagccccaaggactatgcagtgcagtgagcagaggctcccgatattaaaaagaaaacaaggaaaatggattcctggtgatagaagtggtgtgggggaagacaaatagtgtggctgcaaatggaacaatatgcaaaagaaaagtagctaaatatagctcttttttgggaaagagattgtgtctaagtccatcagtggaaaggcaacttaattgttgtataagtctgttcaggttgccataacaagataccatacaccaagtggcttaaactatagaaatgtatttctcacacttctggaagttgggaagtccaagataaaggtggtagcaaagcggatttctttctaaggtctcttcctatggcctgtaagtggctgtagattcactgtgtgcccatgtgaccatttcttcgtgcaccagggggaaggcggacaagcaagctttctagtgtctctcttcttgtaatggcattaatctcagcatgaggacaccactctcataacctcttttaatcctgattacctctcaaaggccccagctgcataaatcatcacagtaggtgttagggcttcaacatttaagtgcgggagttggtgttcacatttcagtcaattgaggtgacaattgaaatgtgaaaggaaaaccatagttactagagagaacggttgtcttggggaggatcactggacaggactacggtcctgtccaggttgttatggcaacctgaacagacttatacaacaatccagtcctagaggcaatacaacttctctgctgattccagattctgagcgcctctcagtccttggttgggttgttttgatcctgtccatattatatttataaatattctcttcataaaactctctttaggccgggcgcggtggctcacgcctgtaatcccagcactttgggaggtcaagagatcgagaccatcctggccaacgtgatgaaacccgctctctactaaaaatacaaaaaattagccgggtgtggtagcgggcgcctgtagtcccagctactcgggaggctgaggcaggagaatggcgtgaacccgggaggcggagcttgcagtgagccgagatggcaccactgcactccagcctgggcagcagagcgagactccatctcaaaaaaaaaaaaacaaaaaaaaaaccacaactctctttaaatcacacatccgagtgtgtcccttgtttcccaccagagccaagactgaattgagatgatttcttaaggtcaggttgatgtcctaatccagttgtgctgctataacaaaataccacagagtgagtaacttataaacaacaaaaatttattgctcacagttatggaggatggtcagtccaagatcaagttgccagcaggttcagtgtctagtgaaggcccattcctctgtcatccaggctgaagtgcagtgttgcaagcttgggtcactgcaaccttcacctcccaggctcaagtaatcctcccacctcagcctcctgagtagctgggaccacaggtgctcaccaccatgcctggctaattttttttttttttttttttttttttgtagagatggggtttcaccatgtttcccaggctggtctcaaactcctggactcaggcaatctgccagcctcctgagggagtgctgggattacaggcatgagccactgtgcccaccccctttttccagtattacctggacaatgtgtctccctgtcagtatccagggaatggcacctggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcaataaaggaatctctaccagcagacacttgatttttacccttcctaggacctttaacagatatcttgttattactaatctttggtctttgcttgtttaacctccttgtaaagtttgtgtcttctagattacaataattccatgtaaagacgatgctggcacaaggctttcaatccatcccctcttctgacccagaaaataaagacatcctgcctttgggtcttttagaacaggtatccagagattttacttctccagtgctagacagggtctatgcccataacatcagcaggaagcagttacagaagatgaacctccacccttctgcaagccccttaagattaaggaggagtatataatctctgatggggaaatgaggtaggagaccagaaggaccattgaacagagcaggatctggtcaaaacagggtgcagtgaagaagcctgctgaaaccagcagatgatgatgaaagtgacctctagttgctctcactgcttatgagcataaagacactaccactgggaccatggccagtttacaaatgtcatggcaacacaccttggcaatggcctggaagttactttatatggttctggaaactccctgccccttttccaggaagttctgaataacctacctcttaattggcatgtaattaaaagtgggtctaaatacaactagctagcagcccacaggcaccaactctgggcacattgcctatgggttagccctgctctgcaagtagcagcaccagttcaataaaagttgcttgctttcaccagcggcttgcccttgaattctttccttggcaaagccaaggaaactacagtctgggagaaatttctcaggctacaaaccagttttgaggctcgcctgccctgcgtcactatcattgtttccttgggtttcccaggaatgtacatgtgtgagactgctgccctgcttatagatctgtttccctgcaggaaacaggagtatcttgcctggggcttccagagttggagatacatgtagtttcactactgagtgctaacatttaattttggaatcaagtgatgcattcagactggctgctatcattctgtggtatacatgtagtgaacacatttgtgactgagtttcctgcttttagctggagcaagaaagttttgtaattgtgatttgtacaaaaaaatcataggcaagagaatgtgtgtaaaataaactttattgtcagaggtttctaaaggcttatccttcaaggaaagtggacatatgctgaagagctgataaacagtctacagcagtgttattctaacttaatcttgattccaagtccttgccattttcctctagctgctgttgactccagttatatataggttgggggaaaggggattatttatggatctaggcatcattgtctcttgggcagttatcacatttgcagactgaagggatgtgatttctacaatcaaactgtccatttggaatacaaatctggagtggctataaaatttgcttttcagagatggagctttcagatttggactttcaattgttctgttgttttagtttttctcatcaactggggaactgtttgtgactaagctttgttaaaagtagagaagaactttccatagttccaacattagttgctacttgaaacaaacaaaaacacacacgcacatacaacgaaacaataatctttggtgaggtcttgctgatacctaactgaggctagagtgagagctaagtggtgatacaggccaggtgcaaactgagtgcagctaagtggataatctctggtagtgaactacagtctagaagaagatagtaataatagattgaaaagaaagtctcctgaaatgaactagctggcctgtggtgtaggacacaggaccccagccaccttatggttctaaaagccttgctcaaagccgctgcagatgagttagctaggtctctaccacatccataatactcctctggagagaaataaaggtctttcacacctcccaggaagggatttgcttagcctcaaatgtgcacattcagaaatagcttgtcataagaaagagaggatagtttgcagagaaataacccttctaagtccacatcctattccttttaaataagagagtggtgccaagggaagagccctagaatgtcaaagccaacagggtgctcagataccacccaagtacagttccatctttggccataaggagacaatggtgtcaagaggctaaggccatatgatctgtaggtgaaaaacccaggatgagaatcaaggcctcaaaccttttccactacatcacagatttaggagcagttagagggaaggcttcaatctggagaacactaacaggttttagagattattgggtcatggtggctgggacagaaataaggattcacagaaagatgtttatagtcaatgttcttttacagtaaatgttcttttgggattttccttgataaaaaggctgagcaaaagtgaaaaaaaattttctttctttcttactttctttctttgtctttttctttctttctttgtttttttttttttgagacagttttgctcttgttgcccaggctggagtgcaatggtacaatcttggctcaccacaacctccacccccagggttcaagcaattctcctgcctcatcctcccaagtagctgtgattacaggcaggtaccaccacgcacagctaatttaaaaaaaaaattttttttttttatttttagtagagacagggttcctccatgttggtccggctggtctcaaactcccgacctcaggtgatcctcccaaggtgctgggattacaggtgcgagccaccacgcctggccaaaattaaaaattttctaattgcaattctgaacaacttatgggttgtgaaatcaatatagtggactgcttactactacaggctttatttaaatactaggaagggtggattacacataataaaagattttttaaaaactgatcacaaagaattgtgtatttctcactgcatcttgtggtcagaaaagtttgagaaactgctccacataggcaaattataggttcaatctatccgtctacctctttttctcttctctttttttccatgctatgcaaacaagaccatggagagaggaaggcaaattccatcaatgggtggggttaagccttttctatgaggtagctgcacatttgggacactcctatgctggcgacttgacattctagtagatagattgtccttttcatctttagctacatgttaaaattacttgggagctttttaagactactagtgtcttccacccacctggaagcatttaaatcagaatctctatgtgtagagtccaggcacttgtgttagttaaaaccttactaggctttataatatgacagaatggtttaaagctactgagtagacctaccctatttcccaccattttctttgtttctctttcaccataggcttctttcccatgagaaagtaaagattttagtctctcttttcacagtccgaagtaaatcactatctttctcaactggacttccaaggcaaagatttctctccatttacctatctggatttttacaaagttggcctctggattcccttttcccaaagctaattcaccacaaacgcacccctcaagtcaaggagctgggctttcatacacctgcacctgtcaatcatgggtaaatactttgcaggcagggttgcatgtgggattgacataaactaccaggtattgccagctctgagcctcaggcaagcttgtgactaagtgactccagtagtctgaggacagtccttattcagaagggtctttggaagcaaaagcaaacataggcatgagagggtaaaaaaaaaaaatcccatgtgattttggcttatacctaacagaacttgtgcaagaatggatattaaggtgggtattgtacacagcagagcttagtaaataccaagtctgcagtttaagggataggctgaagagattttgcaggtttgtaaacatttttgccaatttgaacatacttttgtttgcgtttggtttttctcctcagtggtaagagctaggcacgataaggtagctagtatattataatttcaatcaataaatttttattttgccaaggaccaagatgaactacgacgatttcaattatttagtactttattttcataagtttgaaaattaggacttttgctcttttttggctcacggcatctttttggatttcacactttctcaaaggccagtaacttagaatctaaattatgattgcttattctttcagtattctaggggaaagttgatttaatcttgacaaaatgtattcaattaaaataattgttctcttaaatcttttctgtctttcttttctttttttttttctttttttttttgagatggaatcatgctctgtcactcaggctagaatgcagtggcgcaaatttggctcgctgcaacgtctgcctcctgggttgaaatgattctcctgcctcagcctcctgagtagctgggactacaggtgcatgccaccacgcccagctaagttttgtatttttattagagatggggtttcaccctgttgttctgttaaatcttttcaccttttaagtttgtccttctcttctccaatttgcaagagtggggtgtggctcgcaccgaaatactgtatttcttagagctacttattcctggagcctggcagtctgggggcctggagggggtgtgtctagaaagcagccctctctaagttgagaatagctatgagaattgtgggttataaggttttgagcagctctggcctccccgtcctcttttatttctacagtggagtgtggcaagagaagggacccatctgagagtgacttcatattgtggcctttcaccacttacctctggaaatttgattcaggcaagtcgggagagtctccggtattcttctctgagaactctgttttcattatacagctggacaatggaatctatgatttgcctgtagaggttagaggtgcatcctgttccaggaaattattacaatttatgcaagttatacacgtttgcttaagagaatgctttctgcacatttcatgttcttcctctctatcttagcctagggagaaaaccgtggagggctggaacgttagtgtgatggggtggaagcttaattttcacatgattctcaacaaatgccagcacatcacatgtattatcatgtccaatggctgcaatatgaaggaggcttttccaaaatagttacggctttggtatgggaagggacctgcttatggttcttctggcccagcacaatgttatgaaatgatggcctctgtgtgagaacaatctaagaggaggggggttggagagaaccaccttggggtggtagaatgaagagtcaccaagacataagggaagctgatgaggatggcagtagaggagactcattctgctatgtgaggtgctcagaaacctgggttctactgaatgccaatcacataagaagcagagagacagcaggcagtgtacagcagcagacagaagacagcagacagcttaggaatcacaagaatgattttagaagtagatacctctaagatgaaggcatatctttaagcctatttatttacctataaataggaatgatagtagctgccctgcctctctagctgggacatttgtaatgaataagtgaagtaaagtatgtcaaagtgtttgaaatctataaaactctgccccagtcacacgcctttagaaaaatacatattgccagaagcaggctgacttgggcctctcctaccattttcttcatcaaagctgctgtgatgacgttctagcttttctcacaggcagttgttgatgaaaagggtctccttcaggtgctgccactggctctggatctcatcttctgcagccattccaccaggacatggaatgagatgggaagtgaagatgctgatcactaaagggatagtcaggggcctctcgtcaagatccctgcctttcaccattcttttgccaacttcatcttctcatcagggaacataaggcaactttctttaagagcttttaaggtttcaaagaaagcatggccaagtgctaagcaaactccacagggatgcctcccacatggagatatgggaagtataaggcaggttgacaggaggtgggaaaacactgaaggtctctgagtagggcttttctagcactagaaaaggtatgaccacttccttgagatgacttataggtactagggaatatcttcctctctacaaaatatctctcctgaacatattttgtttttgttgttgttttttgacagagtctcattctgtcacccaagctggagtgcagaggcaccatcttggctcagtgcaacctccgtctcccaggttcaaaggattctcatgcctcagcctcccaagtgactgagactacaggcgtgcaccactatgcttggctaatttttgcatttttagtagagacagggtttcagcatgttggccgggctggtcttgaactcctgacctcaagtgatccacccacctaggcctcccaaagggctgggattataggtgtgggccaccatgcccggccctgaacatctttaacagatggtaaagaccttcttctgcaccattactgtgaaattggaaagagaaataaggatgcctttgtcagaagatggtatgactaattaaagccacaaacttacacccatcactgacagaatgacaagcctaatatggtttatattactgtgaaagctcaatgagtgaattaatataatctctttttattgcatagaagagtatataaagcatatagtctcctaacaatccaaacttttgcccccaaagtaaagtcaaacattcaagtaagggagaggagatataggtcaaggttttaatctatacacacaccagagaggctaccaaaccaaagggctcttatatacctaatgaagctccaatggctagcgtggagttattctgggaagagggcatgctggcggcattgctcttagattcagccttttctccagcagatagcctcattgtttatttagatggaattacaacactgagacgaaactaacagacatcttaaaaataccttggtgctgcacaaagattgagaaccctggctatttaccaaagggttgccaagatcaaagtcttgtctttatggaaatcccctgatattccagtagtcagatggaaccttatgggaaagcaagcatctgaggggagatggagactggagcttgaaacccaggaaccattataattgcacctccaaacatatggacaagcctgccaacattcttgggatggctagaacagcttgggaaagctgttcaggaactataattatcaagagtatttcaggaaggctgggtgcagtggctcacatctgtaatcccagcactttgggaggcaggggtgggtgaattgcttgagctcaggagtttgaggccagcctgggcaaaaaggcaagaacccatctctaccaaaaaggcaaaaaaaatagccaggagtagtggcatgcatctgtgttttcagctactcaggaggctgaggtgggagggtcatttgaccctgggttttaggttgtggtgagccaagatcatgccactgcactctagcctgggtgacagaacaagagaccctgtctcaaaaaatatatatatttcaggaaagatgagatgtcccattttaaagaagaagatctgttaaacagatttgtacatgcgcggcagtagtggcagagagtctgccataatctcttcactctctccattctggcctgctttgagtataccggcttgcagatgccggtctggaccagagggactgaggtgaggacaggaacagagcaaattacctgacacaccagggacctgtacttgagagttgatcccagagctgtgttcagcctaatcacttttttaaagtgaatgtttagggcctgcctgcagagaataacatctctcagtttagacagaggtggtgagcatgtagaatgtaggagctactgagagattgatggagctttatttttcttatcaaaggagcacttactggctgtttccacagccgaggggccttcctgtgcatcaaagaggaaggcattgctgctgggaagctggtgggagtcatggcagctggaatgagtcaaatactgttcatctagtgagtactccaggacttcatccatttcttcctcctggacttccctcttgagccaggtgaagtaggcaagacaagggattaaaccaaggcagcctggaaccacatagctagttctgatctgaagctcatggaagaggcaccaaaaccaaagggaccatcacatcaaagaggaagtatacagtccacttttgactgggagtaaagtgtgcctagagttagtatagaagtgaaaaaagcaagtgatcagtgcattgacctcataacacacagataaggcagcagactcaacaactactctacaatacgctcacggcacacaggacacacagtgacccatactgtcggcttcaaaatgctgtgtttaaattttatttaatatgatgtggagtggtccactgaatactggctcttgagacaacacaacctcccacggcttttgcagattttagacccctagctctaaatacttggtatggtttcaatttatttttcaaggtaaatttctggctataaaatatctgccaacataattcaggacaactgtgcagaaaccagataggcatctcactttggtttgtaaccctataggttttaaagatacagaaaccagggatccctggttagtttacttttcggtaagactgactggttaactaagtgtgagaaattactaggaactaggaaccaatacaaaaactgcaaagagaacagagaaccatttttaaaaggacacattgtataatcagtcaacaaaaaaaggaacaatcagcagtttctgctttttctagatctgggacctttaacctcttgagtccttgcttctggaattctctctagatttggtcagtccattatcagccccttcatcatgtagagttacctgggagccagtggcttttgcctgtcttcatttttcttaccattgtgattttctgcaaaccaaaattagaaagagctagtcagaaattaagcaggtcccatttcacacattgcacacatgggccctatatgatcagggacataacagcttacatgtatgttcagaatgctctgtgagaattattgcaggaggcctcaggttgtgtctttagagaagtggcctggcaggcttgccttagcccactggacagggtgttcctgatatggtgaatcatcaccagacgtcagctgcctgaagcagagcaaaaagttttaaatgccttttgttccccagctcaaagaatacttgcctggctgccctttggacttctccagttgtaaccttccttcctgctacaggctggttgccagaccacgactgtttgtcccattgctactcacacacagaacctgctccagtctctgagaggacaaatagccctgtcctacctctactccaaaaccagaggactgcccaggtgccttcaagtctgtccctgttgtgcttcctcagatgttgttgggggtaattattttttttcttctcagtttgttagtgagcattggggttgattctgtgaaaaatattccagtataaatcaacttttctaacaccagcttctactatatacagtgcctgaactaaccccaaaagatttggacggtttattgggacccaaaaataaaaaaataaataaccctgaaagagaaatacactcatgaacattaagatactacttcaactgatctgtacagcagccatggaattatgatttgactcactttacaaatggggaaacagaaattcaagaaggatcaatcacttgcacaaagttagtaaatacagtgctgagactagagcctaggtaatgctgattcttagcccatgggtcttcccattctaacaagctgccttctgtcatactgttctttctgaccacaaagatggaatggagacttctgcttctggccaatttggagtaatggggacctgatttgtcctccaccttaaacaactgagaaactggaaaaagtattttaaactctatcttcaacattggatatagtgcagtactataataaataaaagaggtgagccctatgattgctccagtttgctgcctgagattgtcaactgtagagcagggagggaggacccaggcagagcctggtagtaactttgaagaagacagggtggctagacatcacaggacagactagagaataggttgctgcacagatagaatgccttggatatctgtcttcagtcttcagctaagtactgattagtacatgtatttgaggaaattatgcaaagcagggcaaagaacttcccaaaaggaataatctctgtagctcacacatagcttgcaacacttggtgtttccatcagctagtgtgaaaatcccttttaatagagggagcattggttagaacaggagtccccaacccccagcactggtccatggcctgttaggaatgggaccgcacagcaggaggtgagcagccagcgagaaagcattaccgcctgagctcagcctcctgtcagatcaacgatggcattagattagcatcggagcacaaaccctattgtgaactgtacatgccagggatctaggttgcatgctccttatgagactctaactagtgcctgatgatctgaggtggaacagtttcatactgaaaccacccaattcccaacccctaccaccccacccccaccttgtctgtggaaaaattgtctttcatgcaaccagtccctggtgccaaatctgtgggagatcactggcttagaatcttcaaaagagtattgcccccaatgtaaactatggactttgtgtgataatgacatgtcaatgtaagttcatcaactgtaacaaatgtgccattctggagagagatgttgatagtctaggaggctatgcatgtgtggaggcagggggtatatgggaactttctgtacttcctgctcaattttgctgtgaatctgaaactactctaaaaaataaggtctattttcttaaaggtcattttgcctccatagtgggaaaaaaaatagcagttgactaatagctgctcttatgctgcctaaaaaaaattaaaaagccagcttggagagatgaaaattgtttttaagtaactttattgtataccaaaacaaagctcaaataattttaacacaaaatgcaaaaaaatccagcacccaataagttacaatgctcaatgtctaaccccaaataaaataatgttaggaatgtagagaaacagaaaactgtaatccatgataagaagggggaaaaaatcaatctacttaaactgacttagaaaggacacatcaggtgagaattaaaaaacaataaaaaggacacagatgagagaatctgtagataagcacattgaaacaaatataactgtataccttgtattaaagaagctaggccagtgtggtggctcaggcttgtaatcccagcactttgccaggccaatgtgggtcacatgaggtcaggagtttgagatcggcctggccaatgtggtgaaaccccgtctctctgaaaaatatgaaaattagctgggtgtggaggcatgtgcctgtaattccagctactcaggaggctgaggcacaggaatcacttgaactcaggaggtgaaggttgcagtgagccaaaatctcaccactgcacttcagcctgggcaacagagcgagactctgtctcaaaaaatagaataaaataaaataaagaagctagaggaaaatatgaaatgatgaagagttacatagaagaacttaaaaaaagacataaattaaatttagatgaaaaataaagtctgagatgaaaatacactggataggattaacagcagattagatgctgctgaagaaagattaatcaattccaagacatggaaatagaaagaaacagagagaaagaaaagatacaacaaaaatgaacagaccattagtcagctgtggtaaaatttcaaagcagctaatataaatataactggagtctttgaaggagaagatagagagaaagaatagaatatacattatatatatttgatgtatatatgccaaatataatatattgtatatgccataggtaagactatgtatgtcattattattcaaatttgatgagaactataagcatgcagatgcaagaaactaaataaagtagaacaatatgtaaaagagaaaactatacaaggtcttatcttaatcaaactgcttcaaacgagtgataaatagaaaatctcaaaagcatccagagaaaaaagacatattatgtacagagaaacagaaataagaattatggcagacttcttgttggaacagtgtaagccagaagacagtggaatatcacttttcaaacacttttttaaaacaaaaactgtcaactagaatcctacatccagtgaaaacatcttccagaaatgaaggtgagttcttatgctcatcaagatgaagtaatccactatactctacctctcttactgattgaaactaagaactctcaggccaggcacagtggctcatatctgtaatcccagcactttgggaggccaaagcaggtggattacttcagctcagtagttcaagaccagcctggacaacatggagaaaccctatctctacaaaaaatacaaacattagccaggtgtggtggcacacacctgtagtcccagctacttgggaggctgaggtgggaagattgcttgagcccaggaggcacagattgcagtcagccaagatcatgtcactgcactccagcttgggtaagagagcaagactctgtctcaaaataaaaaacaaaacttagaattctagaaagaatatgaaaagtgattacctgagtgctctaaagagaaaacaatagaatgcagattaaggaccatagtcaaaactaaaataaaatctataatggagataagtttgcattttttctccccactttggggcacttgggaggagctaagggtcttcagagcctgtagccaacttacctgtggcaagttttctgacaaggatctctgtcagctggcttccttgtaccatttgctcacagaatctctgtctctggtagtaggcaatgtcagtgttcctgagaaggccctcaaaagacttgactgtgttcttcacatgctgggtgaaaaggtagcagacacctctcccttcctgtatcttctgttgtaagtgggtcagttcttcagcctgagcctgaattaagggatcatgtatcctaaggtgggaaagaagagtaaaatgtatgagggaatgtagtgaataataggttatagaagtttcagaggagagatctcttagaatccctgtaaggaactcccaagttgaattctttttttctttttttttgagacagggtctcactctgttgcccaagctggagtgcagtgatgtgatctcggttcactgcaacctccgcctctgactccgcctcccaggttcaagcaattctcttgcctcagccttccaagtagctgggactacagatgcccaccaccatgccaggataatttatatattttttgtagagatggggttttgctatgttggccaggctagtcttgaactcctgacctgaaatgattcatgcacctcagtgtcccaaactgctgggattacaggcatgagccactgcacctggcccaagatgaattcttgtacaagttgtgtgacttgcctgtggcagaaggaatgaagaggcagccttgggtttgtctgttattttactaaatttcctttaaaaagatgcccctttggttccccactttagcccatgtaccttttcatatgcagtaactggcagaaaaaaaaaaaaaagccaagttcaaaactgttgggccggtatctctagtattaattgaaagttaaaaagaaaaatcagtgaaaaggtcaagaggggcagtattcttctgaatgacatgaagatagactataatcagtaagaaggcagttaaaactaaagttctggccgggcacagtggctcatgcctgtaatctcagcactttgggaggccaaggcaggcagatcaccttaggtcaggagttttgagaccagcctggccaacatggcgaaaccccatctctactaaaaatacaaaaattagctggtgtggtggtgtgcacctatactctcaactgctggggaggctgacctaggaggatcacttgaacctgggaggttgaggttgcagtgagctgagatcacaccactgcactctagcctgggcaacagggtaagactccatctcaaaaaaagaaaaaaagtaaagttctgagtagtaatttcattactctgtggggatttattttttttctaattattgtttaaatatttctcatggtgatatggtttggctctgtgtccccactcaaatctcatgtcggattgtaatccaaccagggacctgctggatagtgactggatcatggtggtggatttcccccttgctgttctcatgatagtgagtgagttctcatgaggtctggtcgtttgaaagtgtgcacctccctctttgctctctctctctctcctgctctggccatgtgaagaccatgcctccttcccctttgacttctgcaatgattgtaagttttctgaggcctgcccagaagcagaagcctgtacagcccacagaaccatgagccaattaaacctcttttctttataaatcaccaatctcagatatatgtttatagcagtgtcagagtggactaatacacatgggttccaatgtagagtgtgagctctgtgagtctaaagatagtgctacctattacccaacttacagcacccggtagtatgtacccatacaagtagttattcagttaatgtttagaaccatgtaatcccagagctagactgaacatttacagtcatctaacccatctaatgcttgaattttctccccaccagtcttctaagtagttatctgcaggtcctctttcaaactctatttcttagagttactagaaagtgtcaggggaagtaaagacacatactggggagaaacaggggctccagacctatcccaccttcaatcaaatatctctgctttggtgagttttacaaatttgagcttctatgatttcatttcaacaaaggattaaaagaagtttcgaatgctacaatctaccttatgtctgaaaccctctaaggatagtcaatgctggtcctgagcgaattaataattcattttccacacaacagctgctcaatcatctatctacccaacagccctaccagttaatactccacctagtataatacttttttaaaaaatttggaggagaaacattgttatcatgaaaggcactttggaaagtttgaaaatatctcttatagaaaatattaatgacaatcaccacatctataaatgggaacaaatataataattacagaaaatagttgttcagagttttatatgtgttagagatggttctaactacttgcaattgtgcatttaatcttcataaccctctaagtagatactgtcagtatttgcattttataaatgaggtagcctaggttaatgacacgcagaaaagtgaagtaaatttgaccaaggacacacaaatagaagccacattgctagtattccaatgcagacagctgtctccattttactaatatgctatttaatggaaaaccctagagacctaactagaccatagcctcattgtgtcttagtctagttctgtgcctgagtcatacatttctgcccttctccttgcacaaatttgctctttgttctaccagcctgagctgccctacttcaaacagtatttatgcacttcccacagaggtacctccttaccggagccttgcagctgacctcggcaattcggccagctccctctcctgaaactgcacctcctcctccagcacagattctataaggtctttgcactcttcacactctgagaaaagatagacatgcctgcatcatggaaggctggccatgctgctgtggtcactgcctgcagggcaggaggcagggtctatctcaaggataaaagtatccccagtaccaggctttatgctgggatttccatatctgtattcctcagtctctcaactactccctgttttagagatgaggaaagaaaagcctgataaagtcacttgacaagatgattcagctggaatgaggcagtcagaattcacatcccctgaggtctgacgccacatctttttcttttcttttttttttttttttgagatggaatctcacttttttgcccaggctggagggcagtggcacaatcttggctcactgcacctctgactcccgggttattctcctgcctcagcctcccaagtagctgagattacaagtgtgccccaccataccctgctagtttttgtattttcagtagagacagggcttcaccatgttggccaggctgctctcaaactcctgactgcaaatgatccacccaccttggcttcccaaagtactgggattgcagtaagtgagccaatgcacccagccatgacttcaaatcttaaggccaatttaccaagccttacagcctcttaagtaaaacatgaacataagggcatgaaataatgacttcctgtgtgtttgggaagatactaagaatggtaggactgatggtcctcctgtgtcaggagtttcaataatcccaaaatatttcaaagatttaaacatttatctgtatacagctgtgtaaaactgtatatagaggagaaagatccaaatgatatgtgcccaaaagctaataggtggtgttttaaagggagaaccaacacatagtgtttgtcatggtactgttgcagtaggtttttaagaattatcatcatatgatcatcaccaccatccaaagaggtagttcctactctattaccattacagatgagaaaactgaggcacagtgatgataagttagatttgaacccaggaaatttggccccagggtatatgctttttaatcactgcacaataatacctttatactagggtcttaggtaatatctttcttcttctctagcttgagaaatttttgtcctacaattataatgagtgaaggtttttttttttaaactagtttttccacacaccaaagctcatcttttcacttctttaataagtgggcttttggttttacttttctatgacagtaagttagacagcaacttttagccaccccccacacaatgatgtattttaaaataattgtagaaattggaaaacaaactcaatttctatgttaaccagaatcctcttctaatatccctgttcctctcatgcccttgttcccatgtttccttgtcattacagcttcccttccctgactattagtaacaggtttgggattttacagtggatttaaaaatgtgagagctaactgtggagaggaaggggccagcccctaacctggcctggccttctattgagaatggcagtctgttccacttggccttgttctcattttggccatatgtctcatagctctgatcctggatgtccacctgcagttgcttgctgtctgtaaagttgatactcagagagagacagaaagggtgttacaaagtctctgatttttctggaaataccctcaatctaaccagagcatgaggaatggcttatctgaacttttgtgggaagagaatcttgatccaggtatcataaagacttttttctgtgtctgctattgaagttcacatctccacatatctgtgactcagttgagaatagctagttttaagttccttcaaggcagatagggtataatattacttctttcatccctggtgctgttggcactgtgctttgcaaatgggcgctcttaaaaaagtttaaatcgaatcctgagatgttttaaccaacagtgatgttacatgtttgtagaatctgatattcattgctgagaggggaaagacagtttcatgcctaaaccaaggttttagtctctattcctcactacactcgccctgcaaactttacacctttgtgcctcagtttttctgtccttggcaaattgagagtaaaaggcccacttctacctttctgggagtgtagttagcataaaattaattttgatagagaataaagtccgcagtgtttcatttcacagaggaaagatgggcaatcatttatcactttggtgaccatgcccctttgggacctactatatttctgcaggtgattggccaggcagtaggcagtagctttggatgtcaggaatttctctgtgaggtcttggaagttctgtttgcacttttccagttcagagcgcaagtactgattggtttccaggatgctcatttctgcccttggaccaaaacaagtggtggcagatactgccatgctgaagcttgtggtggaagtagaatcagaacccagacaaataataaattaaaaacaaatgcatggattatggtaatggttgcactacttgggtaaattactaaaaattattcaactgtacaattataatgggtaaattttatagtatgtaaattatacctgaataaagtttctttacattaaacaaaggatttaaatgagtcaaaagaaagcagatctgattcataacttacttttgggataaatttcatcagcatcccgcaactctgagaatccttagccacaaaaacaagacaaaggtatctaagcttagactctaaggtactgtctgtggttcaggctctgataggaatgccagaggtaagacccagtgccaggtaatggtctggagtcacaatcagaattagaaggtgggggtgtcatggaatgttaggatctctgccttccaggtgtctaggccatgtggaaacacaggtctcttctgaaggtcaccaccaatggagaccactgcctcagcaagtcaatctcagtatttgtatacccttgtgacaataccacaggcctatctctttctaaaattcaaccatattttcattgtttattattgcaagtgcatagaaaacatcaaggaatacatatttccccaagttctatcgctgtcttaattactatcatgaattcattttcttcctaatgaaaaatttaacacttttagatagtcttggtgttcttctttggttctccagatttccacatcatttatattataagaaaaaaatcctgaatattcctctcagtgtgaataattgacttatatcgatttagaggccaggtgcagtggttcacacctgtaatcccaccactttgggagaccagggttgttggatcacttgagctcaggagtttgagaccaacctgggcagcacgacgaaaccctgcctctacaaaaaaatttaaaaaattagccaggcatggggctaggcacggtggctcatgcctgtaatcccagcactttgggaggctaaggcaggcagatcatgaggtcaggagatcgagaccatcctggctaacacggtgaaacctcgtctctactaaaaatacaaaacattagccgggtgtggtggcaagtgcctgtagtctcagctacttgggaggctgaggcaggataatggtgtgaacccaggaggcagagcttgcagtgagacatgattgctcactgcaagcttgggtccaggtgttttttgctgtagtgaaccaagatcatgccacggcactccattctggatgacaaagtgagaccctgtctcaaaaaataaaaacaaaataaataataaaaggattttggtcaatatcttaatatacttcttgctgcaaaccaatgttatactgacatcttttcccccactggggaagcatgttagttttttgtttttttttttgcttttttttaatagaaagggtctagctctgctgctcaacctggagtgcaatgacatgatcacagctcactgcagcctcaaactccgaggcttaagtgatcctcctgcctcagcctcctgaatagccgggactgtaggcacatgtcatcacactcagctattgtgtgtgtgtgtgtgtgtttttttttgtgtgtgtttgtgtagatggggtctcactatgttgcccaggtgggtctcaaactcctgggcccaagttattctcacactttggcctcccaaagcattggaattataggcataagccaccacacctggcccatgctggcttttcacttaactcgaggacaagcttgatattcataactcctaaccccactctcctcttctatgtgtggtttgcttagtgttacaatctctgtatacatattttgtgcttgtcacttatgattttcattctaactccacatgctttctttccaatttgtcacaattgctgaaataatttatgtatatctctttaaatacatgtagttgccacctaatttggaatgacttataaactgttactattttatgtgtttgaagcagtttttatggaacactaatgatttgcattggcctgagtatatattctcagacaaagcatggtaaaaatcaagttaatgagtctgtggtggttggcggtgatcaacagttttcctgtgcaatggggtttagtgggatagaaactgaggttttaaagacaggcatagataggcagaagagaagtcatcccctgatgtaactcttcacttcctatgtatcaattcctccctggttttttgagactgagatagggagactcttatggaatatctgtcctttcccttcagctgcctgactttcctgggctactggcctacacatgtgtaatcatggtcacctccacattcatgacaaacagaaggaagcaggaccaacaaactgcataccctacatgctaacctgaaactatagtgtgtgatagtattagtttatgagatatatcagaagttatatgattttagtccttttaaatttattaagatttattttaaaggctagcatatggtctattctatagaacatcctgtgtgtacttgagaggaagtgtattctgtttttgttgagtggagtattctatagatgtctggtaggttatgttgtttaaatcttttatttctttattgatcttctgtgtagttgctgtatccactattgaaagttgtggtattaaagtctccatctactattgttaaattgtctatttctcccttcaattctgtcactttttgcttcctgtgttttgaggctctattagatgcatgtgtatttataattgtactctcttcctgatagattaacccttttatcattacaaaatagccctcattgtcttcagtaactttttttgtcttaaagtctcttgtttattttgtctggtattaggatagttgctactgaaacaccagaggtttgatttaagtcttgctgttcactgcacagaaagccaatcactgagccaactagctttgctaggaaagaaggctttcatcaggtactacaacttaggagatgggagatcagtctcaaatccatcttcctgaccaatgaaaattcagggtttagatagcagggaagaaatggaactacatgcaggaaaacaggaattagggagaggtaagaaagaggaattggtcaacaggaagcaggtggtcacttaggcaattttgatgggataaggggtctgacatttcattgtccagatgtggtactctggtaaatttcagttctttgatactatctggagggcccaacgcttggtttcctgagaaaggaactcagataatacaaatgtaactttctcaaatttcaagactgaaagggtcaatttctatgtttattcaaaagaaaccgtaaacatcagttctatgggacaattgggttggtttaaaagtcacttcagctttcttatggttgctaattacataattatattacattgtatggcaaagggattttgcagatacaattaaccttaaaatggggagattataaaggttgactaatctaataacatgggcctttaaagtctggatctagaggtcagaggtcagcaaactaggaagtcagagagatccaaaacgtgttagtgattcaatgaggaagaaactcttcattgctgactttgaagatggtgagagtcacaaataaataaagtcctcagtccaacaacttcataatcagtgctacctgcaaatatgggctaacaatatttttaaatgcatttacaatatgtggtgaacagattcacattgtctctgcctactcttctcttttgctttgtccctgcatgctactatgtctgtctagatgggggggcacaaacatcagggctttgtgcagacttctctcctttcctggaatgctatggctctctagagccagatagcactgctgaaggtggctgagtacaggcaactgatggtgttagaagccacaggcccttgattaatccaggctctaatcttcacccacctcaaagtcctaagagtcctccttatagcttcctatctgatttatacagattattacccacaaaccttgctcttccttggacccctaagaccagggcttctaatatcttcatcatttttgaggtatctaataactcttctttctggagtttcagttacttcatccccactgccgagtgaaaagttaccagatgactagcacaaagtctcatatgcaaatcagggctaaacagcgagtggatgatattttgtctagatcagccatgggtattgtcaaatgtgacaagaatattatttctaaaagttccacactacagaaacacactagaacttacttcccacgttaaaagacaacctggaggagtggctattacatctcaggccaagcattaatctttccaggattacaacttggctcccaatgtcgccaagctattgcttagtcaaattatttaatctctgttataccaaaattatttccaggcccccacaatttgcacctggctgctatacttctatgaagactagaattacctatgagtaagagtccaaaataagctttctaaatcaattcagacctgtctcacatactttttggtttacaattgataaccatgaaggaattctgagtggaggtgccctgacctttgacaaatctcctatctgtacttggtaccagcttgagctatttttattgctcaaaccaataggaaaatttgctgaggcctcagagatccaccccctccagagaatccctgatttcccaaaatttgatcgagatctaaggtttattttgctgtacaactcattttctggagttttacttgcttccaacaatgaaggcaacttttcctgcttccatgatgatggagagcaggcaattcctttctggggtttcagttcacttctaacagggaaggagggaaggagagtttgagttttttcctgcttctaggatggtacagagcagtcttcagcctgggccccattcctaggtaagtaactgaacctgtgttttgtcttgaaattctcctaaatgattaaagttatgattaacaaccaggctgaggcaagagaatggcgtgaacccgggaggtggagcttgcagtgagccgagatcgcgccactgcactccagcctgggcgacagagcgagactctgtctcaaaaaaaataaaaaataaaaaaataaaaaagattaacaaccaactgatcataatttcttcttaccgttagagtgctaggcaatcatataaattgtgcgatcattaattttctgaactgttttttgttttctgtttgtttttattgttgtttccttcttttccccattgggtttgaccagttctatctgacttgatcaaatccaaaggaatgttccaaattatggggacaagacctctgaattggataaatctctgcagaaaaataaataaataaataataaaaatttaaaaagagggagagcagggaaagaaaaataaataaataaataaataaataaataagcagccatcatgaaaataaaggttttcattgggcacggtggctcacgcctgtaatcccagcactttgggaggccaaggcaggcggatcatgatgtcacgaaattgagaccatcttgacaaacacagtgaaactctactaaaaatacatctgtactaaaaatacaaaaaaattagctgggcatggtggctggcacctgtagtcccatttactcaggaggctgaggcagaagaatggtgtgaacccaggaggtggagcttgcagtgagccctgatcacaccactgcattccagcctggacagcagagcaagactccttctcaaaaaaaaaaaaaaaaagagagagagagagaaaataaaggttttgactaccagaggggctttatttatataacaaggccacctttgctagccaaaccaaactaaaaaagcaatggttgtcacctcgtaccccaggctgcagttcagtagctaaggttctgccctttttcaccatgacaacctgggtttggttcctaaatcaatttctttccagtttgatatttatgttacttttgaactttttttttccagggagctttcttagcaggatcattgctggctttcaccccagctgttacagaacagcttgactgaattcaaaatccagaagctcagagtgtatcctgggaagatggtggaatgagaagcacctggaatctagacaacaactgcacaggcaggatctgtctgatgtaaatatttcagagctctggagcctactgatggcttgcaacttctggaggaaggcccagttggtaaattgtaggtaatttcagtcaatttcagcccttagcacaatagcagctacccaacactacccccaaagcagtcatcttgtgttcctacagtaagttacaagctgctagcccatttcttagaacctctcatttcctttccatcgtggaaatctatcctcaaggaaacacttctcagtgttccatctgctattctactacccctcagggattgctcaggcccctccctttcctacacatcaagctaggggatttgcccccgcccaggactggcaaattgactttactcatatgcctcgagacaggaaactaaaatacctcttggtctgggtagacactttcactggatgggtaaaggcttttcccacagggtcagagaaggccaccacggtcatttcttcccttttgtcagacatcattcatcagtttagccttcccacctctatacagtgcgatagcggaccggcctttattagtcaaatcacccgagcagtttctcaggctcttggtattcagtgaaaccttcatatcccttacggtcctcaatctttaggaaaggtaaaacggactaatggtcttttaaaaacacacctcaccaagctcagccaccaacttaaaaaggactggacaatacttttaccacttgccttctcagaattcgggcctgtcctcagaatgctacagggtacagcccatttaagctcctgtatagatgttcctttttattaggccccagtctcattccagacaccagaccaacttggactgtgcccccaaaaacttgtcatcactactatcttctgtctagtcatacttctattcaccgttctcaactactcataaatgctctgctcttgtttaaactggtggtttactctgtttctccaagccatcacagcttatatctcctggtgctgtccccagatttgccactcttaactccctcttaaagtcaataaataatctttgatggcagggctatgctgaacccccttgggcactctctaattggatgtcctgggtcctcccaattcttagtcctttaatacctgtttttctccttgtcttattccgttcttttttcaattcatacaaaaccatatccaggccatcaccaataattctatatgacaaatgctccttctaacaaccccacaatatcaccccttaccacaaaatcttccttcagcttaacctctcccgctctaggttcccacacctcccctaatcccgctcaaagtggccctgagaaacatcgcccattatcactccataccacccccaaaaattttcatagccccaacacttcaacactattttgttttatttttcttattaatataagaagacaggaatgtcaagcctctgagaccaagctaagccattatatcccctgtgacctgcaagtagacatcaagatggcctgaaataactgaagaatcacaaaagaagtgaaatttaaatggcctgttctgatgacattccacaacaaaagaagtgaaaatggctggtccttgccttaactgatgacattgccttgtgaaattccttctcctggctcatcctggctcagaaagctcccccactgagcaccttgtgaacccatccctgcccgccatagaagagccccctttgactgtaattttcctttatctacctaaatcctataaaatggccccacccctatttcccttccctgactcttttcagactcagcccacctgcacccaggtgaaataaacagccttgttgctcaaacaaagcctgtttggtggtctcttcacacggacgtgagtgaaacacacaatgggatgcagaggcttatataccgtctcaagttaacagaatgaataaaggctcaaagcatggccaaaaccaggtaccattagagtcagaggtatatccatttattgtgggcaagacaggttatgggagggagagaagaggaggcctggctagcaaaggtgatcttaatatgtaaatgaaaccttacaggcagcagctctcagaaagaataagctctaaaagtttctttcagacctttacagctgtcagactctcagttaatctttcctagatctgggcaaggaaagacttggctgcatcaatgcagattccctacagatgcaaatctcctcaacgaaagacaactttgcagggctacttctgcagctggctttctgaacagacatctcaaaatatgtcaaagaaatgtattttggggtaaaatatttttaattccttcacatctacagcctgatgcacctgccgtttcaacgcaccattgttggtggcaattccattctttcctacaattaagccaaaagaacagattctccttgaggctagtctttttctcacagcacacatacaatttctcagaaaaattctgtctcctgtttggttaattacagactttaacctgcccaatctttctctttcttggtctttgaattttggcaaaggagtctcctgatacaggcgggattgattctactgacgagtctcaaaaccgtcagacatttaagagccttaatcttggggtggaggtttgggccacccttgaacattttctttgagactaccggaccaaatcagcctggccaggcctgtcttcaaggcccaggggcaggaccaggtaggtcctcccgacgcttcttgaagcttctcccgcgtgtcggcagccaccctcctcttccgtgtgacctgcagagaagcttcagggggcatttattcaattttctaggagcccacgaggcgcaggtgagcggtgacgctgtggttcccaccgcaccgccgcgctccttggtcctctcgctgtctctggcgggcagtaatgttccaggtgagcttgggctcctaagacaccaggcagggagggaccagtggggaagggcaccggccccttaggtccttcgcagtagggatccgaaaaaggtcttgaagaaatagaaaggtagagttggaagtagatcaaagggaaagaaagaaatcctaggagattttctatctgaaggcaccatgaagagatactccctcttctgggccgggtcctcaggtcgctggtgaaccgagttccgatctacgttggagaccaaaccagttgactttggcttgactcctagtgaagaagccacgctttgtcctcccctgtttagctcttgatcctgaagcacttgattagggctttgaattccagggatgcaaatgagaagtttgtttttaatgcacttccttgaagtaagagtatttgaaagtatttttgcgaagaaaaacatttccttttgcactgaagacattcagatgtgaggaagatcactcagctggggaaagcaaatgctgttgagaatgtctcacaaacacaaattacatgtcagcaggtaggtttgaccctcaggttgggcacattttaagtgcactgttggtggaatttaagatgaatctaggacattcatgattaatatttttagttttttaggaaaatttaatattttaaatttaaatacacattctgaaaattgcataaccagcacaagaaaccggctttatgccattttcacaaacacatgaaagatgatactttaaatggcaatgcttcataaatggcaacatttttaaagtactagagaaaaaaattaacctagaattctatgcaaaaataaaatttcaaaactgtgagtgaaataaggacattgaaaaacatacaaaaactaaaagaattcaccaacccacgctacaagaaatcttaagagtcctccaggcagaagcaaaaggatcccagataaaaatctggacctatacaaaaacaaatattggaaatggcatttagaaagcatgtactgcacattttcttataatttaaatctttttaaaaatatttgacataataaatgaaattaatgataatcacaaaacttataatgcataaagtaaaaatacgtaacactaggataaaggccagaaagggaggtataattacacttgaaagcagaatgtgataaattaaagatgtatcccagaaaccctaaagctgccactgaaataagagaagggttatagctaataaagcaacaaaggaaagaaaacggaattaaataaaagctatgtaaacactatgctggaacaactactctccaggcctccaccctatagaaatacaccagtggccaatgagaagtgtacaagaatgatgactgcagcatcgtttgtaatcataaaataatagaaccaatgtaattttaaagatacataaaaagggttttatttatttaacaaacagacaattgaacaaacaaacaatggaagcaagtcatttgccaaaaggaacacagagggtcatgatgatctactcctccaaggatttcagggttcccagacgcctagttttctgtctagttctggaagatgttattcttggggagcaataggtcctcgagtttggggctctttcaggttctctctccatttccccattctgctacaatagataaacaaacaaaaacaattctcacttccagaagatcccgcctgtacgtctgcacgagcccttcaggaggtctggatgtctggttcacaactcccctgcttcttttccagcttttgctttcccttcccccgctcccgccctaccgccccacgacccgaccaccgcccagctgagccccagaggctccacagcgcagaaggtgcaccggaggccgtgtcagttgcccgccccgcggggtgccaagaaatcaacgctttgtaaaaagaacttccccgtggaaaaaaatctcttgatttccactctcacctctcttcaaaggactaaaagctaaaggcgacaagggattcattcgacaagtcctagtcgtgcgcccttgtgagtgccagaccctgctccctgccaggggacccacgagcgaccctcaccaccatccctgccctggtggagccccgggcggaacacaggatccgaagatggcagcggaagctccgcagcagcccaacagcgactgggcagggtggatacaggctccttcactgggtgaaggcggcacaaagaaccggaagaaccatcccgggagcccaccgggcgttcagcttcccttgggaccccaggcgtctcgggctgggtcgccgaccggggcgtttctggggtctctccctctggctccagaatctcctaacgcgcaggtgtccaacgtgaccagcgcgattcaccgctctaatatctctggttttccaagaacttgctcagtcgtcctgccaggcgggccctgggaatagaagggacagaggaagtttagtgagtgcgcccttcctatatggcccagtggagttagcagtgcttgtctctgtggtgcaatcggttagcgcgttccgctgttaaccgaaagcttggtggtttgagcccacccagggatgcttattggaacttttaaagcatgcacgtattgtcaatcactacataaatggggaagaattagccactaatttatgactgatccatgtcaagggccagccagctccccgaccagattcttaatcgggtatctcctgaaacggcgggtttacacctgtgtaactcaggaatcctgaaacagagacctaggaacccacttctggtgtgataaaattctaattcagtcgattatacgcttaaatgagtaacttacttgtctccgttttttcatattttagtaataggagtccagtagtatctccaggatgtgcctggatttactgattggtctatcaataatgtgaccagtggaatcattcatcatcatagtgatcctctccatcatttttgaaaacagtatttttcctcagtttgtgcattatttatttaacccttttcaaaatgtttttgttagccaggcatggtggcatgtgcctgtaatcccaggtacttgggattctgaggcaggagaatcatttgaacctgggaggtggaggctgcagtggaggctgcaccagtggaggctgcaccgctacactcccgcctgggcaacagagcgagactccatctcaaaaaaaataaaaataaaaaaataaagtttttgagatgaggtaggtttcattgttttaggattacaaagaatgctgcagccacctttcttgtacacatatctttggtcattgtggaaatgtctacaccgcagatatttctatagtgtagggaagttgatgcactattgctacattatagggtttacatgatgcttctaatttgagtacattccgcaaatgtatctttcacgggagccgtaccaaataatattccagtagcaatatttataggaggaaaaatgtgcagaagtgcaattgagcttcgtgcctctccatggggcccatgttcataaaatggtggcattagcaatcatctgagagtggaggagtttgtggccctctgacatcaaaagctgaagcagaggacatgaaaaccctcactgtacatcctctgtagtctggccagaatcattcctaggtcagtggtctcttatcaggagggaatgctgcttgcttgttttgtcaaaaccacaaaagggagggaaagtttcaggccattggttgataacagtggagaggcaagtctttccaaagggctggtttgttaacccttaggaaaaaacatcctaattcttaccagatggttccatgaagttccaggcttttggtgtcccaaacaaagaactgtacatgacacacataaagcagcaaagcaaagcaaaagtttattaagcacagtaacactctcagagtggggagagtctgggagatgagatcagtattagtttggtgtactttgggtctttttatgtgtgtttttttcttctcttcacagggatgcctaatctttagccagtgtttgtcttttgattgacaggtgcttagttactttggcccttgtgtgcttgcacgttgcctccatcccataattttaagtacatgcatgatatgtagtccatatgcatgagttttaatgagctgattatcatatgaagtcatgttaagcatactttttctctctaatgcacatgcctgtctctgaggagctgctcctttactggtttggatattgcaggccatggggtccttgcttgctgttttttgtttttttgttggttttgttttgttttgttttgagacagagtctgtctctgttgcccagtctggagtgcagtggcacaatctcggctacctacaaccttctcctcccgggttcaagtgattctcccacttcagcctcccaagtagttgggaccacatgcgcacaccaccaaccccggctaatttttttgtattttaagtagagatggggttttaccatattggccaggctggtctcaaactcctgacctcaggtggtccacccactttggcctcccaaagtcctgggattacaggtttgagccaccaagcctgatcaaaaaaagattttttaaaattattcttttaggccagtcgaggtggctcatgcctgtaatcccagcactttgggaggccgaggtgggctgatcacgacgtcaggagtttgagactagcctggccaacatggtgaaaccccatctctactaaaaatacaaaaattacccgggcatggtgtctggtgcctgtaatcccagctactcgggatgctgaggcaggagaatcacttgaaaccagaaggtgaaggttgcagtgagcagagattgcaccattgcagttcagcccgggcaaaagagcaaaactctgtctcaaaaaataaaataaataaaataaaataaaaataaaataaaataaaataaaaataaaataaaataaataaaataaaataaacaataaaataaaaattattcttttagccgggcgtggtggctcacgcctgtaatgccggcactttgggaggcccaggagggcggatcacgaggtcaagagatagagaccatcctggacaacttggtgaaaccccttctctactaaaaatacaaaaattagccgggcgtggtggcgggcgcatgtaatcccagctactcaggaggctgaggcaggagaatcgctggaatccgggaggcggaggctgcagtgagccgagatgacgccactgtactccagcctggcaaaagagcgagactcgtctgaaacaaacaaacaaaaatattcttttaaacttgtgtcatggccgggcgcggtggctcacgcctgtaatcccagcactttgggaggccgaggcaggcagatcatgaggtcaggagatccagatcatcctggctaacacggtgaaaccccgtctctactaaaaatacaaaaaattagccgggcgtggtggcgggtgcctgtagtcccagctactagggaggctgaggcaggacaatggctaaaccagggaagcagagcttgtagtgagccgagatgtcgccactgcactccagcctgggcgacagagcaagactccgtctcagaaagaaaaaaagaaagaaagaaagaaagaaaaatgaggaagctactgatagtccagtatggtatactgtgacagattgaaaaaaaaagtggttatattttgcagcttctctcatcaagagagtctatttctcctctctttgaatcttggattggctatatgacttgctttgggcaaatgttggtgccttcgcaaacctggcagaagagaggcttgcacatgggaggattacctgcttttttcttcacttgaaatcctgaggccatgatctgaagatcccccaaagctagcctgctagagagatcacatgaagaaaaagatccatgcatcccactttttccaaccaatccacctataccccagatgtgtgaggccatcctagaccatccagccccaaatgaaccagcttggactagaagaatttccaagccaactcacagaatcactaaaaataataaattattgttattctttttttattttttaagagacgagatctcagtctgtagcccaggctggagtgcagtggcatgatctcggctcactgcaacctcggcctcccgggttcatgccattctcctgcctcagcctccctagtagctgggactacaggcacctgccaccacgcctggctaatttttgtatttttagtagagacggggtttcaccgtgttagccagcatcgtctcaaactcctgacctcgtgacctgcccgccttggcctcccaaagtgctgggattacaggtgttagccaccacgcccagccaattattgttattctaagtcaataagcttgggatggtttattatacagcagaagtgtatcaaaagggtgatggtagttgcaggaaataaatatatacctttaattgtatatgcataaacatctttggaatgatacctccaaaatacaaattcccatattgaaagagcacactcagtacccagcatggtggatggaaatatatcatgaagtttcaaactaataggaagaggtagaagattctataggcttttgggaggggagatgggagaagagtttaaggcaaataacaaagaatcagagcggcatccatcttctctatggtgctgatgtgctccagtgtataaccatcaggaacaaacctatagtcaaacctgagtatattggctcattgcaacacaggagacagcaaacactatggggaaattgtggggcaattcttcctttgggaatctcggtatttttatctagaaagtgggagaagtggttgcaagactaaacacataattggtaaagaatcaacagtcaatacaaaagttagccaagtatggttgggcatgcctgtaatcccagctacttgagaggctgagggaagagaatcacttgaacgcaggaggtggaggttgcagtgagctgagatgacgcccctgcactccagcctgggcaacagagactgtctcaaaaaaaaaaaaaaaaaaaaaaactggcctggtgcagtggctcacgcctataatcccaatactttgggaagctgagcggggcgggggtggatcacaaggtcaggagttccagaccagcctggccaatatggtgaaacccagtctctactaaaaatacaaaaattagctgggtgtggtggcaggtgcctgtagtctcagctactcggaaggttgaggcaggagaattgcttgaacccaggaggcagaggttgcagtgagctgagattgtgccactgcactccagcctggtgacagagcaagactccatcacaaaaaaataaaaaataaaatcattaaccgtcactattagtagctgggatgtttgatcatattatggtttgaacagtgttctttttatgttcaaatatgattgtgaaatagtatttctttcagtttagtgagagggtaactttgtctgatattggtgttgtgaaatttttcgttttaaccatagaacaccatggcctaggtgtttgtcagaccagctctagctcagagcagaaaaggcttacctttttctttctcagaaatgactatggaaaacagtaaacaacaagggccaggagccatggctcaggcctgtaatcccagcactttgcaaagccaagggaggcggatcacttgaggtcaggagtttgaaactgtagcaggagtcatagacaaaatccctcagacacccgattgtggaatgtaagagcttttttcagctgggaccatcggtagactcacatcctagaaaccgagctccccaaataagtaattcttgtcccttttaagggcccacaactctaaaggggctgtgttgggggggtcatgatcaactgagcaagcaaggggtatgtgactgggggctgcatgtactggtaatcagaatgaaacaggacagaaaagggaatttcataatgcttttttatacaatgtctggaatttatagacagcacaatcggtgaggtcagcggttgaattttaacaaccaggcccgaaatgtggcacccagttgtctgagcgtgattttcacttctgcccattctttcaacctccactttttcagcaaacaagaaattaagtgtaagacaatatgaggagtggtcgctctcaaaaccagcttggccaacatggtgaaaccccatctctactaaaaataaaaaaattagccggacatggtggcaggcacctgtagtcccagctactggggaggctgaggcaggagaatcgcttgaacctgggaggtggagattgaaagtgagccaagatcccaccaccgcactccagcctgggcgacagagcgaggcgagactctgtcacacacaaaaaaagcagtgccttcaaaaatctcagagagaaattatttccacctatctttttgtatctctatctagtaaaatatcaattaattttatgggtataaaagacattttcagacatgcagtgtctcaaaaagtttatttctaaggtaaccactttataggaggttttggaggatatgcatcatcaaaaggaagaagtgagtgaggaatgaacccccttgagatccatgaagcaggggatctaacaagagagaggcgatggaaatcccaagatggtgcagtaaagagagatattatgataacagctgtgggataagcctgaagagcaagtcatccagaatggaacatatagaaatgtgccaggaaaaatttctttctttctttcttttttattttttatttatttttattttttgagaaggagtctcgttcttttgcccaggctggagtgcaatggcgtgatctcggctcactgcaacctctgcctcccgggttcaagtgattctcctgcctcagcttcccaagtagctgggagtacaggcacccgccaccatgcctgactaatttttatatttttattaaagacggagtttcaccacgctggccaggctggtctcgaactcctgacctcaggtgatccacctgcctgggcctctcaaagtgctgggattacaggcgtgagccaccgtgcccggctgctcttttttatagacgaagaaattgaggtacagaaaatccagtaacgttttaaaagtcacgtcatgaatgaaccaagatttcaacccagaaattgaggcttcactacaagtgaagactggggttttcttgttttcaattattgggagttttggatttccaggaatgtgcaattgtaaaaacccagcttcaggaggtgatgaaataggtgcagtggctctggtgtaagctctgaagccccaggctcaggctctattgaaaaattacttttgctgaaatattcctgtttttaggaacttccatggaacttgagccttcacgcagcatattttggcatctgattcaaagctaatagaggtccggaggattcccaggattaaagtctttaaacagaaactgtgaatcttgcctaagcaaaaggtgccatccctggatgggcttgcaccaccaacctttcagttaacagtcaaacgcgctaaccgattgcgccacagagactctaatggcttgtgtcttaaactcatttgctgataccagaaatggctttttaacctctggctgcagataatctcatatatttgatgcctgtccaatcccgcgcactccagaaacccagaatacgggagacaatgaagccaagagtcgagtctttgggcactttggacgttctacccgggcagagtcagctgggggactccaacggccaaagggccacctgctcctcaccgtctgctcttcactgcttcccccgcctgctcttcaccctctcaaaagtcgctggcccctctacaggtgacaactgcagcttctccggcgaaagtcactcgctttcccattcttagccccgctcacaccttgcgctcacagtcatttccgccaggcctggaccagcggacgcgcgcgtgggaaggaccagaacccgtggtgtcctcactgcgtccccctcgggccctcagaggtgggatccacaggaaagggacctggagtttgcacaggctgcagcccttcgcccagagccaccctagcacctagtaggtgcccaataaatgctcagtgaaggaaggcattccaccgcagggttttaggagaaccatgaattcctgggtgaacattaagcgtttagtcctactaggaagtctggaatatagagacttgaactgtttctcaaaggcagctgttcttgtatccccagagccggtttagaatccagcaaaggcccctgcccggtgtatcccacctctggagacccgaggatagtgcggtggggggcaccgcgggttctggtctttcccacgctcacgtccactggcccaggcccaaaggaaatggctgtgagagcaagatgtgaagatagttacaaataccagctagggccagtgacagttgcagaaatgaggacttgtaatagttaggagtatttcttcattattttgagatgaatacatttggttatatattaaccaatacttttcttgagaattctcatcttccatcatcctcgctatcatattcattaatagttaacttttagaaatctcaatatttaggttacaggatagcaaatatggaatgtgatctagctaaaaaaggagtgaacatcattcaaagacaaataaaagactttatcctgttggggaaagggttggcatattttcactgaatgagaaaaagtatgattttcctattgtctttatttgaaccttaagtatggctttacaaggaggaaaaaggaggaagaagaagagaaagaagaggatgaggaagaggaggaaaagagaaggaggaggaggaaggtgcacattgatgccactttgagaagaagtggactgtggtggatttgtaatgtatcagttttgccaagctgaatgcacatttcccagatttgccatctttagatagctctaggttagcctgggcaacaggagacacttggaagatagaattcaagtggctgttacacgcttttgtatactgggaagggcgttgttacagctcaggcatgatcttcatcttccctgacccttggactggtgggtgttttgcttcttgatctaacattaaggttagaagttgcaggatcccagctgggttttgttacatccaatctggtttaagttcccatattattaggaaagctttagggtgcttcaggaaaacgctttttaaaaaatcagatttggaaaatatcaaatggaattacaggcaataagcataacccagtggaaacatgaatcaaaccctctagagcagggttgtctaaattttgggttccttgggccacactgggaaaaaaaaaaaaagacatttgtcttgggcccagcataatatacactaactgcaactgaaccgtgcgtgtaaagcttgtaaacaaaatctgtctgtaaagtctgtaaacaggccaggcgcggtggctcaggcctgtaatcccaacattttgggtggccgaggcgggcggataacttgaggtcaggagtttaagaccagcctggccaacatggaaaaaccctgtctctaccaaaaattcaaaaaattagccgggcctaattttttagtggcctgcgcttgtaatctcagttacttaggagatcgagtattctctggctgaggcaggagaatagcttgaaggcaggaggcagaggttgcagtaagccgggatcccgccatgcactccagtggactgtttgctgttaataaatgtttacaatgggctcccgtagggaaaagaaaagcttagttttatttctatagaacaaaaaaaaaagttaagagattagtagagacgggtccaccatatttgaccacactgacatcaaactccagagctcgagcggtattaacataaagttatcaatgcatctcacagactactgagattacaagcgtgagaaccaaccactacctggcaaaatctttactttgaaagtaagttacagatgggaacaaagacctgtttattagtttatactaacgccttgtatatgcttccacagcaaacaaaatccacttttaaaacgacaacaacccagggaaaaacacagacacagttccccactgccacaaattatgtaatcaagattcccacattcggggaaatcacaggggtcagcacatccacagtaaaactgctaagccttgctctggaaaaaccaccttcgtgatcataacatttcttctgccagataaacataagtataagctcacgcccctccgccccgccgcagcctcatatgcctcaccctttacacgcaaggtcacttgcgtcacgcgcatccaggagccatcctagccctaacacacagctgcgactctccggtccgaccagaggtcccagacttactcccacggcacgggaactctttcgtggcgaagcagcaggtggcgaagcagcagcccctgcgctgcctcatctacatagaaatcgccctctccgtgatgtcaccgacaacgccttctggatccccgtctgctcttccgcctcacccaacgcccctcagcggagcaacccgctgtcggagccggcgggagaagtgacttatgcctgtcccttctttctctcctgtccccgcccctcgtctcccgcaatgaagcgagtatttaatctgtgtcctgtggaagtcccatttggcggccagctggaagcccgtgcacccttcttcaaataatggctttcaatgagcagactagaacgtttaggattacaaaggaaaccgattcctttcaaacttggttatctttgtgatgtggcactgtgtgcatatcttcgttaaaacgcattgaaggccactgcactccaccctgggcgacaggaggtgactgtgtctcgaaaaaaccaaaaacactcccccctcaccccaaagcattagacgtcaaggctggcagggatgtctgttctcttgaaagttcaatatcaaaatacttggaaattaaactaaaatagtagaagcaagaacaaaaattaagttgaagataatatcaagaatatttcccacaaaccaaaataagaatgtaaaaacaggagagaaaagttcaggaagatagacgtccaaggtccatatgattagcatgcgtatcagaaagaggatagaaaaaaatcagtacaataattcaaaacactttccataccaatggattgaaactacagtgaatttaaagtattgaattgatattgaactttcaagagaacagacttccctgccagccttgatgtctaatgctttggggtgaggggggagtgtttttggtttttttgagacacagtcacctcttgtcgcccagggtggagtgcagtggccttcaatgcgttttaacgaagatatgcacacagtgccacatcacaaagataaccaggtttgaaaggaatcggtttcctttgcaatcctaaatgttttagtctgctcattgaaagccattatttgaaggagggtgcacgggcttccagctggctgccaaaggggacctccacaggacacagattaagtacccgcttcattgcgggagatgaggggcggggacaggagggaaagaagagagaggcataagtcacttccccgctggctctggcagaggtttggtcccctgagtgctcctttcttgtaagcagttcttgtttcatattttcactatctctgacactattaactgtacaattttttttcttctgtacacaaaaaaagtttgtttcaatagtgaagtatgagtcagggtggtggctcatgcctataatcccagcactttgggaggccaaggcgggcagttcacctgaggttaggagttcaagatcagcctggccaacatggtgaaaccctgtctctactaaaaatacaaaaattagccaggtgtggtggtgggcacctgtaatcccagctatttgggaggctgaggcagcagaattgcttgaacgcaggaggcggtggttgcagtgagccgagattgcaccactgcactccagcctgggcaacagagcaagactccatctcaaaaaaaaaaaaaaaaaaaaaagtgatgtatcttctacagtatactcttccaacttatcagattctgtcattgacatacgatgttgcatcaatacttgtgtaaggggtttaacactactactatatataatatatgtaatatattttatatatatatgtatatatatatataacactaaggtttattaaaacaactctcagtaaacagatgcccctgatgttccaacaaaaaaacctactattattagaaaccaaataaactcctcctcctatgaggaagaaagtaaacaacttctggcttggcgcggtggctcacgcctgtaatcccagcactttgggaggctgaagcgggtgctcatgatcacctgagtttaggagttcaagaccagcctggccaacatggtgaaaccccgtctctattaaaaatacaaaaattacagcgcgcctataatcccagctactcgggaggctgaggcaggagaatcacttgaacctggggggcagaggttgcagtgagccgagatcaccccactgcactgcagcctgggcaacagagcaaaactccgtctaaaaaaaaaaaaagtaaacaattctggaacagtttgaaaaagcaatttaagtgaaaatgaaaccaaaaagggtaaaaagaaaaaggagggaattgtaggaaataacctatatgtgattatctattttcaattctaagtggcttggtataggtttaggcaggctacctggaaagaaagaaataaagaagcagaatgtactgagccaccccctccaccttccttctttccctttcacccagtggccaggcatctatcggtgggggctccctcatctaccccttccccactccacaaagaaatttagtttaagctagcttgcaacatagataattgtaccctttcttatcagctaagtgcagccactagagctgtaagtcaaatgtttgaaaaatcctgagagttataatgcatcgtgtgctgcaataaaatgcagcagaaagaccctaaagaatgtacttgaagaacaatcaataggtgatgtctaggaagattgtggaaggctagtactcagcctatgaggaactgagggagggacctgtgcactagggcgtaaattgcttgttgaaactgtgctgggtgtgcctgcatgccagacacccgatcttgcaagaccgtcattaaaagtctcactttcgctgttctctgggtctctgagttcattgtttgggtttagatgggtgaatttgtttctcacaaatttgattggattgaaggatgaaagtattgatcctgggcgtatctgtgagggtgttgccaaaggagattaacatttgagtcaatgggctggggaaagcagacccaccctaaatctggtgggcacaatataatccactgcccatgaatataaagcaggcagaaaaacatgaaaaggcaagactggcctatcctgccagcctacatctttctcctgtgctggatgcttcctgccctggaacatcagactccaagttcttcagttttgagacttgaactgactttcctgctccttaagcttgcaggcagcctattgcgggacattgtgattgtgtaagttaatacttaataaactcctggctgggtgtgatggttcacacctgtaatcccagctctcagagatgcagaggcgggaggatagcttgagcccaggagttggagacctgcctgggcaatatagcaagaccctgttttccacaaaaagtaagaaaaaaaaagacaaaaaaaagtaagtgtaatacttaataaactcctttgtatatctatcctattaattctgtctctctagagaaccctgactaatacagagtcacataaaaatatgagcctcaggccaggcacagtgggtcacgcctgtaatcccagcactttgggaggccaaagcgggtggatcctgatcacctgaggttaggagttcgagaccagcctgaccaacatggagaaaccccgtctctactaaaaatacacaattaaccaggtatggtggcacatgcctgtaatcccagctactccgaagactgaggcaggagaatcacttgaacctggcaggcagaggttgcggtgagctgagatcacgccattgcactccagcctgggcaacaaaagcaaaactctgtctcaaaaaaaaaaaaaaaagcctcaaagaaggccgtatggttgaagtttatatgcagcacataaaggactaactaggcttggagttcttagggggtggtggccacaggttatgggaggttgaggggaggaaagacatggtgagcaaaggctgtgttgtgatgcagatgtgatgcagatgaagtctctcaagaagcagccctccaccagatgtggtggctcatgcctgtaatcccagcactttgggaggctgaggtgggcagattatttgaggtcaggagttcaagaccagcctggccaacatggcaaaccccatctctactaaaaatacaggccgggctcggtggctcatgcctgtaatcccagcactttgggaggccaaggcaggtggatcatgaggtcaagagatcaagaccatcctggctaacacagtgaaaccccgtctctactaaaaatacaaaaaaattagccaggcgtggtggcgggcacctgtagtcccagctactagggaggctgaggcaggagaatggcatgaacctgggaggcagagtttgcagtgagctgagatggcaccactgcactccagcctgggcgaaagagcaagactctgtctaaaataaataaataaataaataagtaataaattaattaattaacctggtgtggtggtgggcacctgtaatcccagctgctcgggaggctgaggcatgagaatggcttgaacctgggaggcagaggttgcagtgagccaagattgcaccactgcacactccagcctgggtgtcagagtaagaccccgtttcaaaaaaaaaaagtttcctgtcagacctttaaaagcatgagatcttttgtttccttttcctgtgagttaatcttacctggatccagataaagcagataagaaggtctcagagaaagccatttgcagttgatgtttacttcctctacacatgctaatctccctgacaaaaggacagcttttcataggtatttctgtgactgtgttgcctattgcactgcctacatgacttacctggacccctacccagatgttgttggccattgcagtgcctatgtgacatggctgaattcttactcacctttaactctgcttatttttaagaaacaggatgtctgtggtcagaagtttcttcttgggactaaaccagctgaagctggtgaaatccatgatggcagcttacgcaacctctgaaaaacatctagctttattataatccaatttccatgctaaatagcactcccatcagtgcatgacagttgacaatcactgtgacaatgaacggaagagaccaagaaaggacagaaatgaggtgactccttgattctaggaaaatctccatcccttactaagaaaagcatgaatattcctcaccttgctcattcccttcattaaagatcctctatatttgtaacttcctggttctcagtagctgagaaggtgatttgcaagctatactacttctccaattccatgctatgctcctacttctccaatgccattgaatagagcctgcactgcttgacgctcactcttggtttcatacattggctttgcaataataaacaggaaagagtccctttttggggtgagacccctcagtaacatctgcagcccctctaaatagccatctcaaattataccaaaggagtgtattttggggtggcatattttgggcttcccacatggctaagccaacatatagcattcttgctgaacgcagggtgatcagacatcacctagcagatggtgaaggatgaggagccctattagatattatgagtgatcagctattgaagatggggaattctggctaaattgactgagaaggattcttgctgagattgaacaatgcagagaggaacacagaagctcaatagttgaggcctagtgagaagaggactcagaagagcctgattagtttggccaaggagatgtcaacctgaaataaatgaaaggttcagaattcagcgttaaaatgtttattcattctgcttgtgggaactaatggtaaaaattaaaaaagagtttattcaaacaaaaatctgggaatagccaatcagggcacacagactccagagaaatggggtcagtgctgcaaagtcaaaagtgaagttcttgcttacatagaaagaaaaaaaattaataggatcacaacattttctatataaggctgctttaagagttacaacaaattaattagttgcagaatttttttttttttttttttttgttattgttgttgttctgagatggagtctcactctgttgctaaggctggagtgcaatggcatgatcttggctcactgcaacctctgcctcttggtttcaagtgattctcctgtctcaacctcctgaatatctgggattacaggtgcccaccaccatgcccaggtaattttttgtatttttactagagatgggatttcaccatgtgaaccaggctggtctcaaactcctgacctcaagtgatccacccacctcagcctcccaaagtgctgggattacaggcatgagccccactgtgcccaacctttttctctttccatactacttgttttctttctttatagctggctcacatttcctttccaatttaaaggagtgtatttaacattgcatcttaagacaatgcaatagccatgaagtctttatgagagcaaggtaagaaggaagttaatctataatgaaagtcagcagtgcagagggaagcaatcttccctggcacccttcaataatttgtataacatgttagaaaacaatgcgtgtggctgggtgcagtggctcatgcctgtaatcccagcactttgggaggctgaggcaggtggatcatgaggtcaggagatggagaccatcctggctaacatggtgaaaccccatctctactaaaatacaaaaaattacctgggcgtgatggtgtgcgcctatagtcccacctactcgggaggctgaggcaggagaatggcatgaacccaggaggccaaggttgcagtgagccgagatcatgccactgcactccagcctggcccacagagcaagactccatctcaaaaaaaaacaaacaaacaaacaaaaaaaaaaccaacaatgtatgtaaggaagaaggccaatctataatcagagaaacaaaggttacaactgcctagtttacaggtgcctctcatgtgacttaggctccatactcacattttcttcttttttttttttttgagacagagttttactcttgttgcccaggctggagtgcaatggtgcaatctcagctcactgcaacctctgcctcccaggttcaagtgattctcctgcctcagcctcccaagtagctgggattacaggcatgcgccaccacacctggttaattttgtatttttagtagggatgggctttttccatgttagtcaggctggtctcgaactcctgatctcaggtgatctgcctgccttgggcctcccaaagtactgggattacaggtgtgagccatggtgcctggcccatactcacatttttttaaggctcacagtaatttggaattccaacaacttacattttaaattacttattttcacagaaagaatctttgtcagttgtaactcgcttatttctccaaagaccatagtcctgtccagtgatcctccccaagacaatagctctctctagtaactatagctttcctttcccatttcaatttccactccaattgactgaattgtgaacaccaactcccacacttaaatgttgaagccctaacccccagtgtgatggtttatgcagctggggcctttgagaggtaatcaggtttaaaagaggttatgagagtggggtcctcatgctgagattaatgccattataagaagagacactagaaagcttgctcatccgccttccccatggtgcacaaagaaatggtcacatgggcacacagtgaaactacagccacttacaggccgtaggaagagatcttagaaagaaatccgctttgctagcacctttatcttggacttcccaacttctagaagtgtgagaaacacatttctatagtttaagccacttggtatatggtattttgttatggcaacctgaacagacttatacaacaattaagtcctagaggcaatacaacttctctgctgattccagattctgagcgcctctcagtcctttgttgggttattttgatcctgtccatatatttagaaatattctcttcataaaactctctgtaggctgggtgcagtggctcatgcctgcaatcccagcactttgggaggccgaggcgggcagatcatgaggtcaagagatcgagaccatcctggccaacacagtgaaaccccgtctctactaaaaatacaaaaaattagccaggtgtggtggcgggtgcctgtagtcccagctactccagaggctgaggcaggagaatggcgtgaacccaggagtcggagcttgcagtgagccgagatcatgccactgcactccagcctgggggacagagcgagactccatctcaaaaaagaaaaaaacctctctttaaatcacacattcgagtgtgccctttgtttctcatcaaagccaagactgatttgagatgatttcttaaggtcaggttaatgtcttaatccagttgtgctgctataacaaaataccacagagtgagtaacttataaacaacaaaaatttattgctcacagttatggaggatggtcagtctaagatcaagttgccagcaggttcagtgtctagtgaaggcccattcctctgtcacccaggctgaagtgcagtgttgcaagcttgggtcactgcaaccttcacctcccaggctcaagtaatcctcccacctcagcctcctgagtagctgggccacaggtgctcactaccatgcctggctaatttttttttttttttttttttttttttttggtagaaatggggtttcaccatgtttcccaggctggtctcaaactcttggactcaggcaatctgtcagcctcctaaaggagtgctgggattacaggcatgagccaccgtgcccaccccccaaattctactaatatatgtgcataattaaatagttaccagccatcattttctgatactttggcaattggttgaaagagtttatctaaagacctggaatccatagaaggcagtctctgtgttaaggggttgttcttattatgcagatgaagcctccaggtagcaggcttcagagagaattgattgtaaatgtttcttatcagacttaaaaaggtgcctagattagggaaaagacctggaaagggattccctgtagcatgtagactttccccacaagagacaactttgtagggacatttcaaaatatgataacaaatatattttagggtaaaatatttttatttctttcagggcctgctatctgtcatgtaatgctacactagagtcaggctggaatttggtgtcttattgctacaaaaagtcttaagatctctgttgtaatgccagttgtgcctggtcggatgtgctggtcagttgtgcctgaattccaaaggaaggagggtataatgaggcctatctgacccctacttcccatcatggtctgaaccagtttttcaggttaactttggaatgaccctggctgagaggaggggtgcattcaaatagttgaggggcttggaattttatttgtggtttacactatagaaagtatttttccagtattacctggacaatgtgtctccctgtcagtatccagggaatggcacctggatcaagcatttagtgttcagttgctacactctcacctaatccctcattttcaatattttgccatgttttccagtgacccaactggccaccatgtcacagactttatggtctccaagggagacccctccgttttatgttttgtgatttgagcaacagactggaatctacttgaaatttgcaaatggtctttgacttgggctttccaattttgctctacttcacagtgttttctgggttatatacaagggagatgatccagtcatttgttaagcgcctcaaataagacatgccctagatgtttttttgtttgtttgtttgttttgggatgggacatggaatttacacctaaaataatcagcgtctgaaaggacgtcccctctctggatatggaaaaggaagaactgcaggagttgtatgcagctgccttgcaatcccatgggaaacaatgctagctcacaggaaggcaaaagctgactgttgaaaagaaaccaagtcctcgaagacattgttaggccccaaaccaatcaacccagaaacccatttaccactgaatctagagttaaataagcaagaaaatccccttttatttaatccagtctgagttgggtattctgtcattagcaaatgaaggcatcctgacatgtgggaatgtcaagacacacaagctcttgtgcagttttccatgcatggggacagtgccctggcattccagaaatcctggcttacttatcaccactctctaatcaactgcaaataacattttaaaactaagtgcaaagagaatgatcaggaatatcataaaatctgcatttatttaaaaaaaaaaaaaggagcttacagtgaagtagtctcaagcaattgctttctttttttttttcttttttttcttttattattatactttaagttttagggtacatgtgcacattgtgcaggttagttacatatgtatacatgtgccatgctggtgcgttgcaaccactaactcgtcatctagcattaggtatatctcccaatgctatccctccctcctccccccaacccacaacagtccccagagtgtgatgttccccttcctgtgtccatgtgatctcattgttcaattcccacctatgagtgagaatatgtggtgtttggttttttgttcttgcgatagtttactgagaatgatgatttccaatttcatccatgtccctacaaaggacatgatctcatcattttttatggctgcatagtattccatggggtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacttcacaaaagaagacatttatgcagccaaaaaacacatgaaaaaatgctcatcatcactggccatcagagaaatgcaaatcataaccacaatgagataccatctcacaccggttggaatggcaatcattaaaaagtcaggaaacaacaggttctggagaggatgtggagaaataggaacacttttacactgttggtgggactgtaaactagttcaaccattgtggaagtcagtgtggcgattcctcagggatctagaactagaaataccatttgagccagccatcccattactgggtatatacccaaaggactataaagcaactgctttctaagtgggatggctgaagcaagagaccttaaatcacttgaccgtcttcacaaaacagaactgaagcagaaccagaagtcccctgatagcctttcagggacaccacctacaaatacaccgtaatccctcatactccacacgccacttcagggaaagggacatgaggcaggaatacaaatatataccatctgtgacacttcctaagctcctggcttcagagtagccatcctgataattattttttaaagtccacattataaatgtgcaagttaagtgagttatggaaatcattccagatactggttcaccagtaacatcagtttagccctaaatattgtcataagttctctgataggctcatgtgatttaagctggtgctctgtcaagactagacttaggtgttttatcctttttatgacattatgtatgttgaagagaatatatgaatatatataaaaccttcattatcacattattctcaatccagcattttctcagcccctgattttcatgttagttcagcattcttacatctttacagattttcatctaagactacatttctattgttttatataatcagcccccctaagatcaacatgtccacattttttggcaaagacaaagcctactgatttcaggatcattattttcctttttcaaaagcacaaacccaaactgagaaataaatcaagagaaattctccttttttctatgctaatttagaagtagagtctttatttcttttcaaacccaaagagaatcagacatacaatatgaatttatctactttcgcttgctcagactgagaggaaagattaatattttcaggctgttagtcaaaactgttcattcaaatattatttaataaaatccaagaaacagctaaaaagtcgcttaagctaagaaaccttcaccagcctcatgggaaattgtgtacagttttccactagaatagcctataaatgcttactgaaaatgtctaagttcatatcttggtaactaacattttaattcaatctgcagaataatatatgcttctttagtgctaagatatgaatattagaggcattctttcttaaaatttctatttagttatactttcacaaataactatataatattaaaattctgcatgtggcataaaacatattttaatggagaaggtaatgtgtagggagtttatttctgtttgctattagaacttgtgtttattcttggttaaaaaaactgcagattacaacatagaaaaaaacaaaagtatgttgtatatctcttacagtagaagataaagagtagttctaaatttagaaaggaaaaataaatatacacagtgaaaatatgtgtcagtgagatgttaatcaaagatcaactattgctgagaccagcaatattaaatccctgcacaattactcatattataatgagaattttaaaaagaaaatatgaacacataacataatgaaggcagaagtcactctcatccttcatctttgtattcccaattcaggaagctggtatagtatcttcattataattactattcaacaaacatttgtaaaatgaatgaataaggaatgaatgatgagaaaaatgataaacatctccctctgtctcctgggagttaactgcactactttcttttaaatttaattaatcctccatgtccttgtaaaatagccaaagggaaaatgtatttacattactctaaatattgatgcaatctacaaaaagtgttaaacaacttcctcaaagtaaataaaatgttcacaatccagctaggataaaaggatttaaatcatttcctaggtagagggctttcaattagagcccctgctgcattaaccatgggaactcatctcactctcttcatgatggagccctgagtgttgctgctaatctgtactctaccattctaatgcttttaaggttccttttcagcccttcctcctcgtaatccacaaatactgagaccaaggcattttttgggtcagtcctaatttcaagcattctatcctgccctccccaaatgaactcacacttattagaccatatgttcctatattagttcaggaagggggaaaaaatgttaatcacacttgtatataagagatcatagaaaaacagtttactaacctgtgaaaataccattcattctctgtttacctctggtccacagctaagcaatcagcaggatataaatgtaccctatgttcactattcagtattcataagtatactacttatgaattggaaatctgacacaacatttacatgacctaattttgaaaatttaaaatagtgtaaggcccctaggcttaattttacaggggaaagattaaagggacacaagcaaacatatattctctctctgtgctgtgggacactggtaattttttgacttaaaatatttgatacttaaaatgccaaacttctacatttctgcagtaacaaggcagttatcatattgaataccatttctttctctccagtaagtagagttaatattagcacatgaactgaaaatattaagtgattataaaaacgtccaaataaattcattaaaatttagcttggcaaaatgttagtttcatgttcttggtagaagtccttttatatttatattcaaatgaaatgaacaatttacaagcaaaggaaatggcatcaaatatttcacaccctgcctcccaaggtgtattgattcatgctttttgctcagatctaggtttctccactcaggaaaagaggagaatgtacccatacttgggaaaacaagtttccgatggcacagctttgatcaaacagcaaaattctatccatctatgtattgccatctgacagtatgacaaatggtcccatgtgcgatattcacactgcattgcagtcaaacctgtaagtcaaaggatatgaaataatagtaactatacattaagcacagaagaaaatgaaacaaacaaaaaggttttaaaccaaccaaaaatatgtcttattttggatgttctatatgttcttacattctctcaggtcttttgtgtcattatgaacacaattctaacaagcttgattattttatttccattcacatattacaggcaacaagctgaaaaagtagaacggggtgtagagagacaggacaaagtacagattagggcttgaagtgcccctgaccagtcgacagcaaccacatggaataatgactcatgtgcattaatgatcacactaaatgatatttgttttttacctagtccttcaactgacagcttaaagaacttcaggttgttctgattcttgagcctcctctacagcttcagagaggactttcattttattttggatcaaatgctccacaactagttgaaactggaattaaattttatatgaagttcctagatgatttaaagctgtaagaagaagaataatgaatcataagaaaacttgctgctacagatatcaaaaaggaatgttaccatccctcatgctaatccttttcattttaaataaacaggatctaaaaaaaataatgctgggaagtcctaaccacatcaagaatgcctcagatcagtgacccaaggaaccttccagaatggatgaaatagacccaaagctgaattcacctaattttagggccaaaaacccaaaaaacaaaacaagaccaaaaaaatcttcagatactgggagaacaaatctcaattgctcaattgtatcttatgaaaacaatttttcaaaataaaacaagagatatttaagattcattaagttcttgtcatttcaaattttaagaaaaatattttctaatggaattacatatatttgtatgattcttctagttatatccatggtaataaatactcttttcagttggaaataaaacccatttgtgctatattattagggaaaatatctacataaattagtttttaatttaactaaagtctatcttttgaattcataagcataaaattttaaccacttgcaaaatttataacacacttaaggtagtcagatgccttgtcaagtagtttaacaaaagtgattttcacctgtttgttttaataacagtgcatcgattttatgaaaatcaggcatgccctcgggtcctaacaaagtatacgaagctgaatggatctatgccaaatatgccagattttactttctgagtctgattttatacttctgtcctctttcttaccacatggcttccagtatcacttacagactaacccttcaaaaggagaaggctaagttactaacatttggaaggcttatgaaagtgaagcatagttatgagccagcaatgtttttatttatggaatgtgtgcaaaccatacacttaagcaagctctggggaatgagagttggggggaatcaactcttttatttgctaattggtatttcctttaaaagatagagttcttccagattttaactgtgttaatagttactctagaaaaattggagatttgtgtgcatatattttatgttgtaaacagacacatacccagagacactgagagagacagacagacagtaaacagaggagcactaaccacaaacggtttacaaatgacctctgtgctcattcacctgtctgttccccaccttgccttttatagcaactatagcaacagccatgagagtcattgtggaaagaaataaaataaaattaaaaaatcctggaagcttgtaaagaatgtgagcaaaggggaggaagttttgaaaaaaatgaataaagggcaccgatccagagtattgaagaaggcagagtggagagcctagtaatgagtatctggtaccccagtatcctctcccacagaatctgtacagctctccgtttatgacagtttaaacttaatttaaattatcaaacagacactttcctcaaacatataaatgatgaggcagttcattcaggctgtatgtataaagttgttccagccacctttttctaatggcttctctatatcttttacatggagacaatgagagatttgcttaggacaatttgactgtaatttagaagtaggaaatgggaagtatttgtatcttctttgcctaactcacattagttactcaagtaagcatttcttccgttattgcattttcctgattacaagttttatgttttctctaaaacacatatcaaaagaaatgtcctaagcactatgcagggggaagccatgacatttatccaccactgtcagcaaaaacatgaacttagccctcaacagaatatttcacttcattctagtgtcacctctgcgtcacctgcactggagtcaccacttgcctgttgggtaagaccaggatgcaccgctgaaataaaaaggggtcagacaatacaagaaaagccagtagaaattgccaaatgtatcagaatacacacaggctttctaaggatatggcccaagaggaaggctctagagcccaccctgaaacaggatttttgacttcacagataaattatttaattttcaataacacaattcaattaaagaaagggaaatacaaggctaaacaaataagaaatgaagacaaaaacccaacctttcaaatctaaagaaaataatctgttttaaagacacagatgaagatcaggaacccaaaacagaagaaaggaaaggcaattaacgttggcatctgataacaacgaaaagtatggagtctggagaatcgctagactctaaaaattataaaggtttagacttggactttgtacactgaagaaaagaaaactgcatgcatttatactgaccaatgtacactattgctgctttttaacttttgtgtatatgtagggtagatttttttttaagtgaaagcaagcttattaagaaagtaaaagaataaaaaggtggcttctccataggcagaaaactagcgtagtttttttattagaaattgttattcaataatagtacatgttacaaataaataccattttaaactgaaaaaattgtagactttcaaatcagttagggtggtcaccctaaaaaagggcattttttccccttagtctccttgttcatgttgctcacaacaagaaatgggctaatgctatgaataataataacaaacactgccttctgtcaggccctgtgctgaataccgtctgcatatgtataggaaagggttaactcagcaggtcttgtttgcccagactctgtacatttccaagaaaggtctgcctttaggactggtccttggccagctcctggagaatgagctctcagcttttagaaaattctatctgctaagaatagttttgcatgtctcaggtcttgggccacaaaatatcagtttaatcagatggtttatgttaacaagtatgatttatggcaaacatagatctctaatctccatttctctctcatatatctatatttatctatccatatatatgtacctatatatatcaaatatgaagatatgtttatagcaattgcatataaatagagagatagtatgtagtaggaagagagacatagatattattcttcattttagaatgttatcttggtatgtttaaaaggaaaaacttaagatgtgttgcaattgcagtatgagtttcaggtatgtacatgttatgtgtgtgtgtgagagacacacacaaacacatttcaaacatgttttatgtttaagctcaatattcaaacacagaaatataacatctattcttaatatgttttatgtaagtacagcagcagcattattaaatactgtatttctatggtgattgaaaattagtaggcagagaatttttgtaatggttcttaataatttttgtaatagtaaatgattactttttgtttagtatagttttataatctatacatgaataaagtggatatttctattcatatagaaatgtgatttactctcatgtacttatctacatgctaaaaccataagttatcaattttagttctgtgccaaggcacttttactgaataaaaataatcagctaattttatattttcctgattcaaatttatatgcccgtgtaatgttccggggttttttttttttaatttctgtaaatcagaatattcagatgttgaaaaagtctttgccttcagatttaaaagatacctttgaaatgtagcatatcccaaaatgcaacccagaggctggcaatgtcaacatttttctgttttaaaaaacctcttatgaaaactattgccatactaaattttttacttgctgatgacttacagctggaaaggattctgtacatataagacatcaaatattgaggatactggaacttttaaattaatggcaaagaaagtcaacaaaggaagttcatatgaaatcaaactagtaatatgattacaaaaaaaaaaagtttaaaatttttcttggccccagtcttatcatttctgagccaaatacaattctatcgaaatcacctgaaactgaaatcaccattctaggctggttttcccataaagatggactgctccaaaaagaggaatcaagaaagaatttggctcacagtgaattattcactttgtcttagttaactaaaaataaaatctgactgttaactacagaaatcatttcaaattctgtggtgataataaagtaatgaccgcttttcagctggagggactaactttttttttttgctgcatatatagctgtggtacattttaatgtgaaatgatgactgcatcagcttatatccatggagcagattttagcattcagcttgggtctcccagtcaatatctacgagtctcttcttaaggagatcgatgacacagatacatacagactaacaaatgtgataccaataatcaagaattcactcagttaagattttgcccactgatttccacacaagaaacctagaatttactagattcttgtgcctgtgaggctccactcatttccctgaatcacaaaagctacagagtatttagatagaaatatacctactcttaacatgaaccattttaaatatatgtattactgtgtccacaggagtacactttaaagcagggacttcactcttcaatctctccaatcacgtgttacctaaagtggcatgtggttccctaaagcttaataactgacattgccttaaaaaaggggtttgcttcccgactaatgtggaaaaagtctgaaaaatgattttaaatctttcactaaatttctcatttggtcacgtggaggaaaatgatttcaccaaatagatactctcattaattttttaatgtaatttatcaaagaaatgaaatatttagataaattccagatttcccccaccatgagcttctccgaaagtatactccatcacagactgctcactaagaagctctactgcagtcaaagtgaccgaatttaaggggacataatgactacttctgctacacagaaacattatccatctctaacacttccctatgagacagaagacggacttctaatcaggtaccagagagggctctgccaacttcagggctttgatgaataagaatggttgagagcgctcatcataaatgaattcagtataactgagtgagaaagtgagagaaccagagaaataaatcctcatgtagaaaatttaggggtatgaaatgccaaatgccagttaaccaaagctttctttgtcataaagcaacttctataaaaattgctgaaaataaattcttcatggctcaatgtgaatcagtaatttccatctctattacactgttgtttacccaaaaactatttttaatgactaagactcagagtttgccagagtgttttccacaaaacaactgttttgagatactccagatctgtaatcaagtaagtctgaaaaaccccaaatacctcactcacctcttggatatgcataaagcacactaatatataacgttctaaaaagccaatcattaaaaccgttttatattgtttaagcatttcctagacatatttggctacaaatctaacatctaattaaacagtttgggaaatgccatcacataatgtaggaatattacttgtcatttaagaaactagaaaatatttactatattctaggcagttggctagcagttggagttctagtctctaaacaaaatactgacttatttctgtgacttttttcttttaagcagctctgtgcttcacaatttttttttcctggtttgttttccacttttgtctgtactttattccttcacagatgtgaaaggctaacaaatgtaaactagttatatgaatcagcctctgcctcagttctacacttcaaatacagtatatactccatcaacaattcttggataataacaacctgtacttgttttacaaacaataaaacaggccgggcaccgtggctggctcacgcccataatcccaacactttgggagaccgaggcgggccgatcacctgaggccaatatggtgaattctcgtctcgactaaaaatacaaaataattagctggccgtggtggtgtgtgcctgtaatcccagttacttgagagactgagacaagagaatcgcttgaacccagggggcagaggttgcagtgagccaagatcgcaccaactgcactccagcctgggcaacaagagcgaaaactccatcttaaaaataaaataaataataaaacaatgatgaaaacacaactaactacagcacttcagagttagttgacaaatccaccttttcaatctacatttcaaaatgttcagaaagacaccatcctaggggaagtcaaccagcagcaacctctctgctaatttttgtacacagaaacttgacctgactgcacaaaagtttcaatagatgtctccctctaaaattaatattgaatgatttgtcatcttccatttaataccaaaagggtatcagccacaaactgaaatatcactcatatgcaaataaataacattcaagacttttgtcgttgtggttattaatcttgtaatggatggacataaatctattcacattctcatcctatcctcaaatttcactattctctcctctcattcttactttgttctactcatattctcactctatcctcctatgcataaaatattatgtatcctaatgaacagagataccattcgtgggcaaggaaaaaacacaatgaactgctctttataataaaaaccatgatcttgacacagatgttatcaatcaataaactttacacagctttacactaaattaatacaaactgctgatgagtgggtggggggtggtcactaagcaaacagaagcatgtaggtgttaggaagcatgagaaacatatatcagtgggtagggaaggcagctctcaaaggccaagaatataagttttaggtctatatggaaaaagctgtggtcacattcgaaggcttctgaacagaagaatgattaatttcatgcttaaagagttcaggtgtaaataaactggatgggtaagaaactcaaaatcaagaattttaagacactgggttaaggtgattgagctaagtcaaagccaacagggcatgggctaaatattgacatgggatgggatgaagaggccaacaatgtttcaaagcagaggttgccggagcttcaggaaccagaagaggaagacttgaggtgaaatctgaaacagcaatccccatacctgtctcaaaagatgtgatactgactaggaaaaggctggagagagaagcttcttttaaagaggtaataagggattgttttgatgtgctgggttgaggtgaaaatgacaaatattcaggtggaagtgtccagcattcaagtaggataacttggaacagaaagcccaaattatgtcatggtgaaatgaggataatgtcttattaataaaaacacgtcttactagtctttcctggagaacatgaaagatagaatttcagaaatttagagaatgaaaaaggaaagattacaaggcaataagttgattaaaatagactaaactaatcagtggcagctatcttaaagcaagatataccttctacagcacgatctacccaaatgcaaatctgggcagagaaatacaaaatatttttaggactgacaaaatttcagctatatgtctttttaaaaatgctgcagagagaaatttagatggattggacaaatatttgcataaggattccacagccaacgtacacaattttccaactactatggttagcactgggctcaggcactacctttgccaaccagcagattttcagtattgcccctggcagacatcccattagcaatctctccccattcccaaacattcccaactattctagtcatgccaattcaaccaatgtcccttaagccttacataaacattgacttacaccgaaatgtatcctatggctcttactaactgtaacttacttaaatcacccaagcctctgttttccctgctataaaatgtaaaatagctgacaaaatacctatttgtattttttggaaacacgggataaagcaaggcaagcaaaaagaacagcagagacaatgcttaataaatatcctagtaggatcaccttaatccatgaagaaaatggagtttaatttttttaatacaaaaaaactcaatgaagttatacttacgttaaattggtggttattttaggtcagtggttttaaaactcaacaatgaaactgttttcaaaaagagttgttatacagaacagaaaaaagcagccacaattttaaaaaagatatgaagacccagattctcactaactcattcagctcccttcatactcactccccacagccaccccagctcctgaggcaggttcccagggctccaaggaacatacttttaaaaaatcagtattttgaatacataataagtgatgtaacttaaaagtatggtgagaaagtcccattgccaagagaaacatgttaattttttatttaaaaaatcatcactcttttcattgtgacatcttgaagaacgctgaatggcttcaaaataactgcatatgccaagatttctggagtgggcacgtttgatcttctttcataatgaaaactgacaaacatttttaagggcatagtattgtttcttcactctcccccctcctcacccctgcacacacatacatttctccttcctggggaactccaaagaaaacaaaggccctttagcaatcaagtagattgtctctcttgatggcatcccatgagttatggaattacatactgcaggcccaggtggattagggcccctagaaagtttgcttgatcaacagagtgctgttgattttttcaactgaattaattactcttggagtccaaactctccagtgtgccacagtcctcatcacttcctgtatcttaaatattgcattatctgtcccctaaaagtatttgaacatgtgacccagagaagaggacttacaacttgactaggcaacttctgtcacactggattcatatgaaattccactgcaagtgacatcaccagattgggaaccctgaagtgtttgagtatcttctccacatctggtcatttaggctaagaaattccttcttgtctaccaggtcttttagcattcattttgtaagtcattcaacacctacttactgagaaggaatactgggctagacagtgtgctaggggctggggaaaccgcaatgcataggagagaattcccatctccaagaggctcacagtcaaacagacataaataggtgattacaatatacactaacaacatagttttagaaacaactagcagaattatatagacgaagatgccaggaaaggcttctcagagaatctggcttggcaaatatctcaacaaagagggctgagcagggatgagccgaaggagaggatggaaagtaggttgtgggtgagttttccaggcagcatgtgcaaaggtccaggagaaagaggaaggagcctgtacttggaggaatattcgattactattatcagtgtcacacttgctattcatctagacagaagctcctgaaacaaaaaggatacacttcaaaagatgccaatatatccatgaccacacaaaagagtgtctagtcatataataaagggtgtacatatgcaggcaactcacatcctgccaaatattaaatttctaattttattataatttctaataaaacattagatttattattatacagagtcatactccttgattgggaaactctcaactcaataaacattctttagtctcatgtcttttctaaaggaaagaaattaatgttatattcttgggtgaaaaaaatgtgaggtctcaaaagagtataatacaatttggggatgcatatatattttacatgtatatagacacataaaaatctaaaagcataaattttaatatgttaacagaagacagaagtcatgtatttcttactttcttctttttggcatatctctttttctaacttttttttttctttttacaaaaaacaattgttatttgtgtacttttaaaacctcacagtaatattttcacactaccttcttggctgaaagttcacactcggaattccagagcagtccatggccaggcccactgggctccccttgctctctccttggctttggtaaccactggccccagggactcagcctgctttcctatccatcccctcagtagctgtcaccatgcaggttaccccttctgtttcttctaccactaactccatgtctgactgcaagtgaaaggaacagaagcccaaacctttgggttttaaggagtttattgctaatctgtaaaacagaaagagacaggagataagcatgacaaaatatagggaagaaatgacttttgcctaaacttcccaattgtgtacaattgaagcctctgctttatagctcttagcacacctctcaaataagaaggcagtactgggaaggctctgaacctgtggcagaaccactgatagctgtggagctattccaaggagtctgggaatcagggggattatcaagatcattgttagaataaattaatcttactgtatatatagcagaagttttcaagcatatgtaaatgctactaataaccaaataattacaccttgtttttctttaaactgtaactctcaagtatgtctctacataattttttgattggtagtgtctgcatgctcaaaaagcttgaaaacactactggagaagaaggtctcgggagtgtgatgaaatacgtttacatggcagcttcatcatttaattggtgaaagtgactatgtgtcttaaactctctgagcctcagtttgcacatccaaaagcaaggatataattccatgaacctttccacctcaagtccacaaggcagaatagcaagatgttaactgccactctgaggaccaccaaataaaaggacaatttattaggccacttgccagcatggacacaatcgactcttggcatttcttattatccacagaaaaattaaaagtataaatgtagaacaaaattatcgtgttttttttaatagtaacatgtaagatcaatctttgtctttaaaataccgtgtatctcattctcggaaagcgtcaaaatgaaaatggtatagtaagttttatctacaacttgaattaaaattattcttgaaatatgttctgaatggttagatgaaatggtaattaaatacaaatagagataatcatatactctctctccataaggctcccacctccttcaatgaagtctagttcacctaaaatgacactattaacattaattcaatattataagttgataagcacattaaatcaaaacacaacaagattattttaagagtctgactgaaatgtcaggatgagaaatagattaataaatattggcttctaatgtcggtaatgaaaacaaacacgttattttcagaaaataaaaggtcttcgccattaggtacaaatcataaagggattatctacggttactacactgtaacaactttttacatattgtattatagaacaagcttttgagaagacaaagcaacacatcagcagtttaaccaattgtctttctcttttaacaggctggtctacattagattagatataaaaggcccaggtattacttgtgttcgatcttagccacatggctgagaaacatccaggtacatttaaatcagtgacaaaagaaaacattatcccttagtaaaattacataaaataggaaacatctcttactttaagagcaaccatggtacttgttcctatggtgaaaactgatgttatctcgattagttaattattcatcccaacacctggtcttgctcccttttccacctctagctatgttaacactagagttcagtaatttgctgataaagaatcttaactgcagtatctaacagatcttagtgattaagcatatgacttaccctttgtacagataagtaaactgaggccaaaagaactgaggtatcttattaaaaatcagagagctagttagttgaaaagtccacctgtccttcctttccacatgtctcaccagaaaaacagcaatggtgaaaagtcaactctgtttttaatgggccactttgtatattttaactgttaaaataatccaagaaggtagtagtcatatacgaagatcctttagatataatgtgtaggaccagcattaatttaatcaaccaagtctcctctcattgaattgttaattcataattacaaagatgacattacagtaaattaagaaatactgtaatttcattctctccaaaaagtatacattgaagtttggtgaatactgttatattttcaactagtaaatcaatgtgccaattctgggtcttaggcatattgtatatactggaatgatattcactttaattaaatttgttttgagatgtagaatgtaatacagatcctacgtgtttttaaaagttcacatcaatttcaagcttttaaaaatgtatgtacacaagaaagcttcttttgcaatttatatgtttacaaatgttgccattagctaagctatattttggaatgtgatcaaacaatattgaatgtcaagtcttaacagcagggctggtctaaggaattccctctaagctaaatctgatcctttcatatgtggctactgctcttttaaactactgtatccctaaagggctaaaaggaagaaaatcctaacttaataagtgaaggcagcaaggcatagtatttgaatggctacctttcattttaactctacttcttaaattcaaaattggatttgggtttgtttcaagttgttcacaatttactaacgaaatgtgcatctctcattcttcccccaaaagaaagaagtcatccactccagctacatataagtctccaatttctgtcttacaactaaacgtgaaaaccgaaataccactcattgaaaaaaaaaatgtacagagaattggcaggctgcatgtttatgtgaaccttcagaaaacatggaaacacgcagccccaactcaccaggaaaatcaacacttgtgatcaaactattttgtgacattttatgtcttttatacatttcacttcatatccagtattccagttttgcaccggcttgcctgtatcaaccccaaatcgcctgagagccatctagtactgtagcagaaccgtttcaacatgaagagttctgctcatcgcctgtagcgtggtcttcgaaacacctgaatcaaacattgattcccctccccctgctatttaaaaccgagggacgtcaggcttgggttgtaggtaaagaaaagccacagtaatcaaacaagcaaccaaaatacccgaacacggaacacgctaagaacaaaggaaacacaagagtgtgaacaggaaatgaagcaactctacacccataaataccttctggggccgccaacataggtaaaagtaaaggtggagtctgagtatctgaaatctgaaacagaaagtcctgtcaaaagctacccctggagtggatttgttttaaccccgatcaggacttgggccctccatttggtggagtcaggggaggcctggccgggcgggaggcgagggctagagggcggcgaggtctctccgcgcagcgtcccaggggatgcggcgcgcccccgactgggtgcagcggcaggccgcccccggcagcaagtgccgggtgccatggcaacggcgggaatttcccggtcggggaggccggaagcagccccgccgggctcgcggcagcgaacgcaaaatccgatctctctcccgggggagcaaaatggacgaaaggcgaccccccaggcaggggcgctgggtgccttgggaatccgaggaatcccttctctttgccagtcggaggggactagatggagccgaaggggccggaaatgggccgagcgctgccccccgggggtcctcggcgccgggcgcagcttacgagctcagcgcagcaggctccattcccggccgccgccgctcagcccattacgcaaacctggcgggtccaaccaaccccgctctgccgccgctgctggaacccaggaggcgtgcttgcaggcttcgggcactacgcggggctggaaataccacgcactgccccttcgcctagacccccgctcgggccacgcgggttctgccctcaaagctggtagctgccccagacttgggggtggggggaggggaaggggcgaggctggcaccccctctggcttttggctcccgcgttcgttgcagcagctgttgccaaatgaaccccggaatgcggacgtgcaaaccctccaccccacccccagccacacacgtcgcggtcagagaactgggaagggggcgcggggtccgaggttctggaaaagcaagaactcacctgcaaacaggcagtcctcagctctggacttctggatcacgacgtcgatatccttctgaattcggtcttgccttgaacacatccccattaaataagtccttggaaaagaagcagccgctatttccaccccaaccccctcgcacgctttcagctttcgtaaatattcagttaaaaatgaaacctctggccgaggcaggggctgaaggccaactggtttcggaagtgatcctgggtgagaggaggagaaggaggaggaggaggtggaggtcggctttccatttccagatgtgactgcccagctgctgctcgccgctgctggattccaatttcctccccttctggcgatggattggtgatgacaccgagtctcactttctccttcccccgcccggaccaaccgccgtgggggccgagggtgctggggacggccggagagcgatcaccggctgggcggcgggagtcgacgaggggcgagccccgctccggctcaagcgcgcacacccctcacggcccgcactccggccttccacacccgtgcacactctcgcccgcgggcggcggcagccgtgcccaggctgctgcagcgccacccgcccgccgcggaccctccgcgccctccgcctagtcacccggcccggccacgggccgccggggcttgcagagtgtcagccatcccgggcaggagtcgcgtctccccacaccgacctccactcgcgccgggagctgagcggcagtgtaggtagtgaagactccctggggctcccagccttccctctccgcgctctccccccatcacttttatgaattcgactccactttctaaaggaattatgagtcttgtggcaaacacaaaccggagtggccgggagggggaaaaggggggaaaagaacacctttaaaaattaaaaaaataataaaacgaacaaatctttacttgttgccacctcagataacacggaaaaagccttgaaattaccccagatgtgcaccctccccttccctcagtgcctgagtctttttcctccagatcgaagtatttcagcccttttggggcgccgtttgcgaaacacagccccttttgagggacttcctcctcttgaaaagactcaccagttctcccttcctaggtgtttctgttcatgagaaattgtcagaatcaactggcacgttccagggtcttcctaaaggatggaaacctgtttggcttgctttttaaaaccacctcctttgacagtcagtccagggaaagctacaatccaggtgttcagaaatgagatactgctctgattctcactttctgttctgcctaaggacacctcaggctgacgtagctgccccacctctatattggtttatgccctaggagaggtctccagcaggcacttttcttgttgatcttttctccgctgagaaggctcccgccagtagaccatgactggttttgctttgcattctcagtgccacgtacagtgcctggaatacaggagggtggcctaaatgttggctgaatgcatgaatggtcatttcttgcagcctcttttcattaccctgtctcatcagctttcttatcagaataagtgcccaagagtgccaaactgtttcagacccttaatcaatttagttctgattctgaccgtgacaacatgatgttcagcacggtaggaatgactgccatctctgaaggagtcttaagattctgtagaatcaatgaaagattctatgttctaaagcctttatctttcaggaaagaaattacaaaatagtttcattgtccagtcatattcactatgagttataagaggaaacattctatctagaattagaaataccatttgacccagccatcccattactgggtatgtacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatagatgaaattggaaatcatcattctcagtaaactatcgcaagaacaaaaaaaccaaacaccgcatattctcacttataggtgggaattgaacaatgagaacacatggacacaggaaggggaacatcacactctggggactgttgtgggttgggggcaggggggagggatatcactgggagatatacctaatgctagatgacgagttagtgggtgcagcgcaccagcatggcacatgtatgcatatgtaactaacctgcacattgtgcacatgtaccctaaaacttaaagtataataataataaattttaaaaaaaagaacaaaacatcacattgtaccacataaaaaaaaaaaagttggattttgcaaggaagatagacatctgactaaagtttggccaagcaaggaatctttgttagtactacttcttgtttaaggaaagaagagacattcatctttccttcaaacaatataagtctcttttcttgtttgatcaccttttattcattaaggaccagttgaatcatctgttgggacttggtagcagaggatatttcctggatagtgtgagctatcaggcctttaatgtgggaagtttagtttctataaaaataaaattaaaaaagattaatagttggaacgaactataaagacagtttctgagcccagagggcagctgatcaataagatttctagatgctgggcttgtagtatcttcagctggtgtgagaagaggcattggattagtttgcagtttgaatgccataaagatgggccacacacaagctgttgtggtaatttttctgaagcttatgtcaagtcatccagtttcagtttgaaggacttcaagaaatgaaaagtttataattttagtgattccaagccagaatagcaggaaaaaaatgaaatattaatttggagtgttgtagctaaatattgtagtaaactagaaaaattgaggatctattgcagattgcaggcagataataaaacctcagaaaaaaaaaaaaaacagctagaatctaatattgggtgcactgcagttttctcccgaaacataacttttctctctatattcactctcatttctgtcaaagataatcaaagtcagattgatttgtttgctaaataagtttaatctcattaaacttgtactggttatgtacacaagtgcagttaagagtagtgattgaccatttaggctcttttaaaggttgcgtttgtcagataagaaatctcagattaaactttttgtttttgtttttttagacagagtctccctctgtctctcaggctggagtgcagtggtgcgatcttggctcactgcaacctccgcctcctgggttcaagcgattcttctgttcagcctcccgagtagctgggattataggtgcgtgccactatgcctggctcattttttgtatttttagtagagacagggctttcaccatattggtcaggctggtcttgaactcctgacctcgtcatccacctgacttggcctcccaaagtgctgggattacaggggtgagccactgtctccagtcagattaaacttttaaaagccacttgaggctgggatacaagcccaaaacttgtcattagtctgcacctgttacatttatagatttagataaatttctctcttcttgaggtccctaaaatatcccaaggtttccagacccaccaagcagtgacattctttacttacctgtaagtctgggaaccctagagccagtttttccaagatggtactttattggttccataaagccaaccttagtcccccaaagccttctggtcatatctgaaaacatgatgtttcagtcaaagccttggtgatataacctgtgtttccagtttgtcctgttacaaagacaacagattcttattaaacttatgcaaataaatacattgccataaaaataagaatatgcacaaatagcttccaaattctggagggataagttagggggaaaaagtaaatatttccattttgcacaaaagtattctttactgaattggtgtaagctagagatagcttaaaagaaagttctctgaaatctggaaaacaaaacatttaaagaactagcaatgtttccaacaaaaagtcattttaaaaattattctcatcagttcattcttgttttgcttgatcttgggttagtagttacatgaacccatcagttttattagagttctggaaattcttaccagtccaattgtatgacgttaaagttgttcagaaacctgtattccagaatactcataagagtattttccataaatctccttgaagaagaagccattttggactgtagctaatttcaaatgcttttagagaacaattaaattaaaacaatgactgtctacagatgacaaggacttaaaatgtccatggttagaaaatctaatgagagttcattgcaatgatgcaatttataagaaaatttggttagcatggcatacagcattttaacataataaccaaaattatgactgataatatactagatttctaggaatctcatacaacttttgtacacttatcctaataatatatccataaatataacttaaagatggcttagcatcactttttatttgaatgctacacatataatttagcatgttaaataaatctaattggtttaatctctctttcatacaaaaaaaaatattctttgtggctttctgagggtccaatatggataatcctaagttaatttgaggtcaaaaagacttaacttagaatgtgattttgggaagattgtcaaaaatgtcaaaaagtttaaaacatttaaaacaaatatgaccatagttatctatttaataaaagctccattaaaagattttaaaggcaaattcagattacatagttgtgaacaagaacttagctcctttaatattgagaagactcacttttcttaagtaaccaaaaacctaataaaacaatatgaaactcaagaaattatcttgatgaaacagagtctctgtttctgaggccaattacttaaaaggaaaaaaataccctttacattctcagaccaacattccaagaaaactttaccattttaacggagaagatcaaattctacttttgaatcaatgtattactaaaactaagttttaataaaaccttataaataaatctatccaatctcagtcagcttagaccatacaagataagattttcacaatccttctagacatcttttcttatttacttttgcaacagacatacaccagacaattaagcaatttacttttactacatattctactcttaggttgaatttatggttttatggccttaaacatctaacagtaacaacacaaacttgtctaatcagcaaagccaggtaaaacaagtgtatgctgacaattctgaaaatgtttctatttttattttaccaatattttttaaactagtttttatttactaaagaatatcccagattatgtgaacttaaaaaaaattgggtcagtttctacttttctgaaaattttatacattcttatttgtttgagtgctcatttatccctagccaatttgggtattttagtttggtaataacgttggaggtagaaaaatatcacatatacataacataataacatagatacacacatgtacacatacacaaacatatagactgatgtaaccagatcttatgacttctcatttaaaaaattttaaccaggccaggtgcagtggctcatgcctgtaatcccagcactttgggaggctgaggtgggtggatcacccgaggtcaggagttcgagaccagcctggccaacatggcataaccccgtctctactaaaaatacaaaaattagccggtcatggtggtacatgactgcaatcccagcaactcgggaggctgatgcaggagaatcgctttaactcgggaagtggaggttgcagtgagccaagattgcaccattgcactccagcctgggtgacagagcaagactttgtatcaaaatacataaataaataaataaaaaataaaaaagacttccctgatcgaaatttaaatcaatttccccttctaattctaaagcagcctccaagatcctatagggtttgggagaaaatttgacttaattgtccaaacttttagcccgaatattatgatttttatcaattaattcacatgtggtgtaagaaggcagggccactaaatggttgaaaagggcgaattggaataattctttagaggatttttaaaaacagagtaaagcagacaatgaaagggtctgcattttggccaaatacctccatgttgccattccccaggttgttcccaaaaatgtagattggagaattcagcaatgcacttaaaaggccaagcaaatctgtctttggtattttaagtggttaagatttattgattgattgattgagacagggcctcactctgtcacccaggctggagtgcagtggctccatcatggcccaccacatcctcaacctctcagctctagcaatcctcccacctcagcctcccgagtagctgggaccacaggtgcatgccacaatgcccagctaattctttgattttttgttttgtagagaggacatcttgctgtgttttccaggctggacctgaatgaacttctgggctcaatcaatccttccacctcagcctaacatttacactgggagcagagatgcatttggagtaggtgatgattttggaatgctttagaagcaacataggtatctgatttcatcaggtcaagccatcaaaaatgaccaataaatctctgacctcttagaagcaatttgaagacccaaattttggccatcatcaaaattcgtgttcattcaaaattagacattctggagagcaaggacaatcattttgctgatgctgcagctaagaatgcagctctgaagttgacatcagacacagaactcctcgaaatgaccttgctgacttatgacccattgaagacttcattagaagtacaagtgggctgggcatggtggctcatgcctgtaatcccagcactttgggaggccaaggctggcagatcacctgaggtcaggagtttgagaccagcctggccaacatggtgaaatcctgtctctactaaaaatacaaaaattagctggtgtggtgacacatgtctataatccctgctacttgggaggcagaggcatgagaattgcttgaacctgggaggcggaggttgcagtgaggtgagattgcaccactgcactccagcctgggtgacagagcaagactctggcaaaaaaaaaaaaaaagaagcataagtgggagctcccaagcaggagagggatctctggaaggataaagggaacaaatttcttccagaaacagtcatatggtatgggcccaatgatacactgatctatcccttaggcttcaattacccttttacagtacttcataagctgactcattggaattcagacaaaatgttggcatggggaaagcaatggtattgaaaatcattgcctatgattgcagaaaatgtttagtcttgccatactgtctgtcccaaacataatcctggaaaaccccttcatgggtcacagggacattttgcctttgggacccttcgagacatggcagttagactttatccagctgtctccatctcagggtcacagatactttctggtgctaatttgtatatgctcactggggtgagcatttccatgctgatgagccacagcccaagtagtaggtagattgtgattagaaaaggtaattcctcatggggggtgccatctgaactccatagaaactgaggaacacacttcgttggtcaggtaatttgatccatttgtaacatttttgcctaagtcccaacatttccattgtgcctgtcacccctaatcctctgggccgatggaatgcactaatgatacaataaaaactcaattggcaaagctaacagaagtttttaacctttcttggacaaggatctcccactggttgtggaaaatgtccacactctccctctttgaaataataacaggaagacccttgcagtggttagatgaaggcgcttatgaatctgcacttcttaaaggtgacattctccattactgctaagatctcacagaacttactaagaactctacattaacaaagaattccattcataatgaactcctgggagatgaaaatatcaaaaatcttggcctataacctggagatgttgttgtttactggaaacaacatcaaataaaatattcttcccaagactgttggaagggaccacatcagctattattattactttatatatttttttgagatgggatctcattctattccccaagccagaatgcagtggcacaatcatgactcactgtagccttgaactcctgggctcaagccacccttctgcctcaaccttccaaatatttgggaccacaggcataggccactgcacctaactgacgacaggtattactgaccaatctgtgccagtaaacttaagggcgttgacacatggattcatgtttctcttgtaaaaggcaaccctaccagagtggacatctgtcagtggagattttcacttaaaggtaactcacaatcttcctgacagagatggcaagtagctgacatctggtgtagtccactttcacccaagatactggcctgtataatcagttacaattccagtgctgaccgtgcctgagagagttagtctcttttttgctgactggaatacatacaccattagggctcctttaagttgtaggggttgtctcttggtggttttggtaaaatcaccctatatgcatattctcttaagatatgacacactactcctgttgcgtgtatgtgtatatacatatacatacatacatacatagcagaatacctgtgatcagatttctgttttactgtccctaattaatttgattacagcagggagggataattctctgattagaatctcacaaaccattacctctgtgggaaatttgacaaggttccaggtttgccactcaaaaccacaaaccacttttgaccataatgacccattggtacatcctgtgctaaatttcacctgtattcctcctgattgcactcacgatgcaactcagggtcatatcaagcaaaacctgtttatctaatctgtctgactcaccctaactttcctgccgcacgtctcagtttaacccatcgtaatcgtattgtcaaaataactgcctgtaatcccagcactttgggaggccaaggcagaaggatcacttgagcacaggggtttgagactagcctgggcaaaatggtgaaacactgactctataaaatatatacaaattagctgggtgtggtggtgcccacctgtagtcccagctactcaggagcatgaggtgagaggatgacttgagctaaggagttcaagcctgcagcgaaccctgatgacgccactgcactccagcctgggcaacagagtgagaccctgtctcaaaaaataaataaataagctgcgtgtggtggtgtgtgcctgtagtcccagctgcttgggaggatgagccattgagccttggaggtcaagaggtcaaggctgtactgagctgtgatcttgtcactgaattccagcctgggagacagagtccttgtcttaaaaagtaattataataaaaataaaaagtacaaaaccaaccaaacaaaaaattgtttcttcactctgaaataacagtggttaacaccatgatgccactggaaagttaaaagaaaaacactccctcctgctatcaggatccaacctgccctcttgctctaaatttctgacccatggtttaaatgcccaaaagctgatgtactcaaattatagcgcacttacttgttcggcgtttatttttgtctcttgaaaagatcaccatccatggccctataaatgtcgaagggcatggaatgatgaagtgcaatgtcattattgttatgtatctctcatcgttttacttctgggaaaactaatttcatggtattctgaagagtagagatgattcaataagtgacagcagctgtagacttaactgaggcctctctctctctctctcttttttttttttgccactctatgatgccctttttttttttaagaccgagtctcactctgtcacccaggctggagtgcagtggtgtgatattagctcagtgcagcctcaaactcccaggctcaagcagtcctcctacctcagcctcctgaatagctgggactaaggtgtgtgccactacacctggctaactttgtattttttgtagagatggggtttcaccatgttgcccaggctggttttgaactcctggactcaggcaatccacgtatcttggcctcctgaagtgctgggactacaggtgtgagccaccatgcctggctgtaatgccctttcaattggacttttgggcattcttaaaaattcctcagtgaggtggcttctttcctcccctgtcccctgcttgggacaggactatccgggaatgagcctttctggcaaagagggacaaccttgacttagcttttgatcatcgatgctttcaagaagaaagattaaaaaaactttttatctgaggaatgtgagccctttcaaatgatcaggcccagagagacgttaaatcgagacagcaaccactttccgctccttccttttgagctgcgctgagctatgtattcatccgttgaaactgcttgctattgcctcaagtagctgtaaattaacctaataatgccacaccaatccctatacccccataccctataacttaacaacatatagccaatcaccaagcaatgttatttctgtaaaccaatgagaattcctgataggcacctatcagcccactgtctgtccctgcttttgaactttaaaaacctgcttgtgggcagggtgcggtggctcacgcctgtaatcccagcactttgggaggccgaggcaggcggatcatgaggtcaggagatcgagaccatcctggctaacacggtgaaaccccgtctctattaaaaaaatacaaaaaaaattagctgggcgtggtggcgggtgcctgtaatcccagctactagggaggctgaggcaggagaatggcgagaacccgggaggcggagcagagttcgcgccactgcactccagcctgggcgacagagtgagactccgtctcaaaataaataaataaataaaaaataaaaaataaaaacctgcttgtgacaaaggcaaaagggagctcagatccaagcttccttggtgtgagtcttccaggcagttgtcttcatgttgactcaagtaaactctaaattatattttgtgcttcagcctccttcttttaggtcaacatgttcaacaacagtagaataaatacataagttaatgtatattcctacaaaggaatacacgtagaaccaaataaccatatgaataacatgaaaaattcatagacataggactgagtgaaagaagtcagacctatgcctctgcttctgcaaccgcctttgcaaaaattacaactgggacaattaccacagtgaaagagatctgatctaactgattccatcttgcttctaacgtacaagctgtccttgttgattgctgggcacaggccgaaataactttgggaggaaattagtttatggtttagctgtgaaacaaagatgataatatccctgtcccgaagcaaacccccttcctgcctggggactagactgcctttgccggactaacaaattagccacgagattagaaattatggtttaggagtcatgtagcctctggctgcaagattctaaacctccccaaattgttcctggagatcacatcgttattggaaaacctaagatcagtgcttgagatattttgccgaccctgcactcagtggatcagctggcaccagctagactgataacctggctcagctggtcttgtggcccccaagcaggaactgacccagcacaagaccacagcttcagctccctgtgatttcatctccgacctggccaagcagaactctcaattcaccggcccccaatcaccaaataaagagtgcagctctttattgcaattcccctgtgtcgaaaaattggctctgtctaggcagcaggcagggtgtacctgttgggcagtaacactccccccaaaacccactacagactgtgactcagcttatatgaaagtaaagggcaggaaaaacttgcctggtagatttgcagagacgggggtggaaaccattaataagtctgtggagtattctcagagtttggtgttgtagtctacatattaaaagtaatcagttaaacacctgaaataaaacttctcccaaatatttttgccaaatttggatgactgtgtttctgtcttcgcagcatataaagtgttaacatgaggtaagcgctaaggtctagagaaggcagtgaagagatgacaaactccagcaccatgcctgaatgtccagtgtgctctgctggggcagcacatttttgtacattgctgtatctgaaaaaaaccctacaagattcatgaaactggacgaccgtctttataatactcctagtgataaaacaagtaaggatggctggtttgcagtcatctgagcagcctctctagtttcatagatacggtttctctctgatattgaacgacttccaaatgtcaagcgaaatgctacatcacaaggataaccgtatgtgaaaagaaccgtttttctttgtaatcctaaactttctagtctgagctttaaaagccattatttgaagaaaagcgcacaggctccagctggccgccaaaggggtcctttgcatcacaggctaaggacctacttctttggcagagaccagggacggggatgggagggaaaggaggtagagtcaggtgtcacttcctccgcccgctcccgcagctggttggtcggccgagtggcagagggtggggcggaagagcagatggggacgggaaaggcgctgtcggtgacatcacagatagggcgattcctatgcagaggaggcagctcaggggctgctgcttcgccaggaaagatttctcgtgctgtgggagctagtccaggacttccggttggacgtgatagtcccagctgtgtgtcagggctaggaggacttgaggcggcatgggggcggggtgggggaatgcgcggggcaagtgaccgtgcgtgtaaggggtgaggcgtatggagctgtggcagggcggaggtgcgttcattcatacttatgtaacaggagaaaatacggccatgaagttggtgttttccgggggcggtttttccattgtactcagtatgtgctgactgactcctgttacttccacatgtggggaaactggactgtaatttgtggtggtggggaattgcgttcgcgctttcttctggaggttgtagtgtaaaaagcagtttgtctaccaagtgatactttcagcttttacaaatgctgaacaatatccgtggtgtgttttcatgtcacctcctctcccttctttgttagaaaaaaatggaagagcacgtggatgttttgagatgagaagaggtgcgttcaccaccttcacctccgtgtaggcttgttattaagggaaagggaacaaaggagtctcacttatgtaagatgaccttacatgagaagaagaaattcgagttggtgaaaagaaagaaattcaatttcagccgggcgcggtggttgacacctgtaattccagcactttgggaggccgaggcaggcggatcacgaggtcaggagatcaagaccatcgtggctaacacggtgaaaccccgtctctactaaaaaatacaaaaaaattagttaggtgtcatggcgggtgcctgtagtcccagttactcgggaagctgaggcaggagaatggcgtgaaccttggaggcggaggttgcagtgagccgagatcgcaccactgcactctagcctgggggacagagcgagactccgtctcaaaaaaaaaaaaaaaaaaaaaaagaattcaatttcaacagtctaatatcctggcatgcaagagagaaattctaagactgtctcaactgtagaaatgttcagggggaaaaaaaatagatgattatttattctgtttcattcattgtctcgttgagtttgtcacatgccaggtgaggtgccttacctgtgttcataacctcaagacataaaagggaaggaattttagaatgattcaatgatatcactgttttgcctaataagcaaataattcagtaagagacacttattaacaaatctaagaataaagcttccttttaaatcacaaaattgcctttcttcacattatctttctttacattctttgacaaagtaccccaacccatcaatattgtctgtcttatccaaactgaaggatgataatccagatttaagaaaatatctatcaaaataatgacaacattgagcatgtactcagtatctgctgggtatagggcacaacaaatatctctcgagttagtaccaggccctgtgctgaggcctccactcctctctagctcatgtgcactgagcagcgagtgccactggctccttgaaagctgcttaggcaccaccgtttttaattcccatgagaggtgctgtgtgcaccccagtggacagatgagggaatggagagcaggtggatacccttgggtagagagccacacatggttggatccagctctggaaggactgaccccttctctacctgactcgagaaagcccactgtcaatgatctcgacctctactttctgtctcctatttctggaacggaaatgacctcgtgcatatttcaaattctccagcttttccttgcctttcctccatcttgtcagtactcaaataggaaaatgatatatacatatatgttgatcatgtacacttaatttcctagatgtaattaagtataaatttcaggcaaaatgctaacttgaatatatttttatgttaaaacttttccatatttcattcacttatcattaagaaagcaaaacctttgcacaaaatattgtgctagcctttgccaggagacagaaatgaggagtcatgggctgtgttcttcaggagtgttgagttctcccgagagtgtgagaatacacaggtaagcccaatagaaagcaaaagtcagggccgggcatggtggcttatgcctgtattcccaacactttaggaggccgaggtgggcagataacttgaggtcaggagttcgagaccagcatggccaacatggtgaaaccccatctctactaaacacacacacacacacacacacacacacacacacacacacacaaattagctgggtgtggtgggatatacctataatcccagctacttgggaggctgagggaggagaatcacttgaaccaaggaggcaagggttgcaggaggcagtgattgtgccactgcactccagcctgggtgacagagcaagactcttgtctcaaacaagcacaaaaaccaaaaacaaaagtcagatgactaaggcagtgatgattgccacatcctgtgcggggcagcctctgggatttgtctcaaaacacactcgatctagttcttgacgcccattgagatggatgctaggctataggcagttacataagatcttcgagcctcagtttccttatctctgaagtgagaaaagtaatattgatattgttaaaaaggcatgagatttagatataagtaaaatacttgtattttacttagtacctacttaatcttcatgagtgagtcaaagaaagcaagtagaattaggcagggttgtggggatggggagaggcaagctgtgctaaagacaggggaaatgggcagatagaatgcagggctaaacacagatacctacaacctgcagcagaggcaacttactgagcttaacatagagaatacaagtcactttaaaatgtacagctctatgttacttttcaccccacaataaaatcggtccttacctagaaaaaagtaaagataaaaatgaaagaaaagaggagtgggggaagtaacacacatgtgtacacattcagacctttggcatgcttacatcagagaaagaacacttttgcaagttttcttggcacaacgaatggtaataatttttaagtctattgtgtctgtcatctattcatatattctgaaactgctgacctctcattgacaacagtatgcctctttttctaagattagaaattttaaaatgtaattgctgataataaacaatggacattatgctaagcgaagtgagccagtcaaaaaaataaacaaacaaacaaacaaataaatactacatgattcaactcattttaggttggtgcgaagttattgtggtttttgccattaaaagtaatataaagtacctggaatagtcaaatgtatagcaagagaaaatagaatggtgcttgccaggggctggagggaaggagaaatggggttgttgttcagtgggtgcagggtttgaattttgcaagatgaaagggttctgtggctggatggtggtcatggcttcacagcactgtcaacgtgcatgatgccactgacctgcgcacatcttaagtggttaatgatcaattttatgtcatatgtattttttcacatttgaaaacacttttaaaaaccattcttgttagtatttaaagaactgcaagataaaaaagagacatttttaaagtgtgaagtcgtgtgcacaggttcatcgtctaggtgtgtactcatgaaaacaaatctcttgtgttgcagatagcgctcgttaaggttgatttctgcatatcagtgagagttcagtgatcttacattcaacataaatatgacaactttacaaacatcccccctttcatccactgagtgagtttatcaggaaaacccaacaaaatccttccaggcctccctgggggaaggtacacagtcccctgctctggaggaggacatggaggctcacgctggttaagggagttttccaaagtcaccagcagcaaggaaccttctgaaactgctgacaagtccgtgcttttcccacgtccacttacattatttaggcaagacccacttgggaatctattttttcaaggcatgatcgggactaggttcaggatggtagagcagggctgtttttgaaaggcggtctctttctctttgcaccaagctttccgtaagtgtgtgggtgaccctcccaacttcctcctctctcccacaaccaccgccctcgctgcttctctcagcttctctccccgacacctggatgactcctcttggctacctgggggctggcattgtgggaggcagccgacgccagtgggtgctgctgggatccctgcccacacccagcagttgcctggagatggaggtatgccaggtatgtgggccaacagctgcagagttgccactgacaggccggaggaggattctttgtcagtgaccgcaccagcccgagcccctgccagctgtcccactcagtatgccctggcttccaggaccccagccaaggaagggtgtggacatgtgatacagtggtggccacaaggcaggggtcaaggggaaggcaggccgatactagcaacagaggaaatgacatttcagaagcgtcctctcttacaaacaagagcaactgtgtgtgtcccagtgagtatgggaagctcagtctcctaacatcattcaagggtctccaagtgactgtgcatacagttttaaaaatatcaccgaacttgtttttcttaccccagccattttttataactatatctagggaatgggttggttgactctaaagagcaaggaactaaagaaaagataaacatggaaacttcaggttttccagaatcttgcatatttccctcctgtttccctattataatttacatttaaaatggagagatatgcagtttaagccaaatgttttgagtcatgaaaacaagtgaaactcttttgcctgttcatgataaaccttcagatttggtgacttctttccaccaaggcaagataggtttcactggggagaactgaactggtgtggtgttttctgccttcagccatctgtgtgtacactgtgacaatatggttctgtgctggatgagacgcctactattttttcatctcactaaagagcctcaagtttctcagctacaacctggaggaagtgtctgaaagctgattttctgatgcccagccccaggcctccttttccaccgcacaagatcagacctgcttttctctaaatcagaattaggcacgccactccagatgaaagagccctgtcgttgaaatgcctttctttggcccacactaagtataatttctgctcccgtttgaactcaaatatcacatgtatattttaacagctgctgctctctaagcaaactgattcacatagaaaatccaggattgtgactacttattttttcctctctacacatgaaacagattccctggaaacacagttatcttaagtagctggaattgtctaacttcggttactttattatttacaaatcagccaggtgagaacaagaaagtgaaaagcaggaaacaagataggcagagaaacaaagggctcgatcgcaagagtagcaagatgcctgagcagacccacagggttctcagggctgcagcaaaaatcaaagaacagtcgtggtctcaggactcgccatagatcagaccacagcttccaaccatgccacaggctgtctgtgtgttccctgcacaccattcatttttgtccttctattttaatgatctgaaaccaagtttgggccatgtgtagacaggccattcggaggaggcttcgggaaggagggtgcatctgagactagttgtaaaagatgaggaggatttccacaatcgctcgaaggaaaggggcatttcagaaagagagaagagcacgttcacgtgagcccagataggagcacggggcacacgcaggaaacttcctgatgctggagttcatgcgcacggtggacgcaggcttggcagcccgcaaggcagaaggggaggtggtgcgggaaccgtggctgctctagcaaacttgagctccattctgcaggctcaaggagacatggagtaagaggaaggactccttgggtgcattgttcatgggaggacaaattagaaaggggattatctcatggcaggcagccacttccaagtagggaagttggagaacttgttgtcaggtggaagaaaagagaagacccttgaaaagtcatccaggaatgggtgtgcacaaacatggagtgtgttcctcatgccgtaattctgatccaggtccttgacttaactgcattgccattaagcttgtgaaaggaggggaaagccggtaccagacattggttatatgtccaatatctgtttgactctttgttagaggtattacctaagttatcttacaatactctaaaagcaattctacaaagcccattgctattttacagaaatgaaatctgaaaatgaagagggtcaagtaaactaagaagtctacgcataactaagaagtggggctgcctgaccccaatcctgcactcttggctctttatgacttcacttgtgagcatactgaactcaaagtgttctggacgtctccaggtagagggctctaggaggcagctgagtacgtgagtctggaacttaggagagttccaagcagggctgtgggtgtgggatggggtgcatgggaaggaggttgtcaaagcaaagcaatgcgcagctgcttagggagggggcacaggagagtgccctggcccttcttagatcattgtcaactcaacttgtctaaatggcttttaagacctcagttatcacctgtattaattctggcctatggtattttgcagctcttcgggaaatagtgatcctttgtttctgacaaatttcttcttaaagggtttattgtcttatttactaggaatcatggggaatagagtgttacacaatgtaattttttccctaacaaatgaagcttatttttataaattccagggcttttaatttgaatcatgcttaactatttttctatattttattacattgtttgcttcctccctaaagacagtatattttagtattttcacagaaaaatgagaagccctcattatgaacatacctgattaaattgagcatttccaagtgatgtccacatcattgctcaagtgttatgaggccacaggatgaactactgccccccgaatgatgctagaatgctgtgcctttatttatttcattggacaactcattcaacatatatttatcaagtgactcctataagagtaactaaaatagaatttcctgcttttgtagaccttacactatagttgattccatagtgtctagtgtttcatgaaattatacaaaatgtcactaaatctaaaatgccattggtaatgacatacactttttaatgcactaatattaaataatgctgaaattaagttatgcttatctaatgtaagatacattgcagtttcagatactaaaatttgaacaagtagacaaacgtttctcttgaaatcagtgaaatctctatctaaatcccttagaatagggttagcacatagtattccaggaaagcaaagctctaattattattgttggattgtacccagattatgttactatttaagtttctactttatgtaaagcactttttcatatggatattctttatcctaacaatagtccatttgttacaccagaagtaacaccagatacttctgaataataatggcagttaaatctgtggttttgtggaattttgcttatatacgtcactgttgattcaaacaatatagcagctctaagaacatctgtgcctccagcctctgcatttcaaccatgagagcgtcatttctctccatgatgcttaaattaaaaatctaaatatttggtaaattttacgcttttctagaatatgttttgttactattatattctagtaaaaacaaaaaatgttcttagcctgagaaagattttacagaaaagctttagtaaacattacacttcataatgtacctgtactacactaaatgcataatgtacttatactaaagagtgaactatattaattatctttgagtttaggaataagatgagtaaatatgtaaatgtaataatgagaaactattaaaatgcagtagtttcattcaatatgattatttaaatagaaaatccaaaaatttgtacatgaattaaattaataaacaaattcaatgagtttactagatacaaaattcattgtccaaaggaattgtatttctttacaccagcaataatgttaaaaataataatttataagattaacttcatatttcatgaaaagtgtaaaatttaagaataaatttaaaaatagtgtacgaagtctttatatacaataatataaaacttttgtacaataataacatcaaaatgaggggtgatatgtactatgttcataggctaaatgtctcacttttataataatgttaattctcaaacatatttatattatgcttgagtttgacaaaattatatacgtttgacaaaattccaataaattcccaatacattttgtggaacttataaactacacaataaaggccaaaacagtccttaagaaaaacaagttgagaagacttgacatatcatgaatgatttgaaatttacaaatttcagaatttttcccattgtaatataagcatgtaatactatcacatttccccaaatggctactttaagtgcatcctacaaattgtgatatattctgtttttgttttcatctttgttctctttgaaatactttctaagttcatctgtgacttcctccttgactcaggaatttttagaagtgtgttgtttcatttcagaacatttggaaattatttatttctagtttcatttagttgtgcttagagatcatactgtgtatgatttctattctttttaatgtactgagacatgtttatatagcccagattatcatcaattttagtgaatgttttaaatgtgcagttgctaacaatgtcttttatattgctgtttagtggactgttttagaaaagtcaatcaggtaaatctgattaagagtattgtttttcttctatccttttgctggtttcttatctcattctattagttactgaaaaaaatgggttagaatctacaatctccaacaataacgggatatatccatttcttttttctgttgtatatttcttctttgtatattttaaagctctattgttgggcaatatttggtattgttgtgtcttcttgttgaattgacccttctaacatcatgaaatgttatgcaattctggtaacatttcttattgtaaaacttaccatttctgtccaaatctatgccctgtccctttataaaataatgatgataacaaataatacataatatttattgtttttttatctcccatttttaaaaattctgggggtttagattatttgaatttatataattattgataaaactaaaatcaaatccaccatctttccatttgttttctacttgttccatcttgcttcttaattttatttttattttttaaatttttatttcatctagagtttacaatacacatctttaacttatcacagctctatgtagagtataaagaatgtacagcaggagaagtcagtttttctcttctgtctttgcactaccattatcatacactttacttcaaatgcatacatttaacatgtgccacaaatcctataacactttattgtttttgctttaaataatcaattatcttttaaggagaaaaaacaaaaaatttttacataatttttatatatttctgggactcttaatttctttttttatagatcaaattttccttctggtattatatttcttttactaaagaaattttctttaacacttatgtagtgcaaatgtgctaataatgaatcagctcagtatttgttctgaaaagtctttttctttttggaagacatttttgctggttaaagacttctaggttggcaaaaatgtttttaagtactttaaagaacagctctatagttcctggccatttttttcttacttacatagattccgatgaagagtctgcagtattcttgattgtatgtagtgggttttcccctcatgagctgttctgcccctctctctcggttctcttcttctggcactccaattacatatacattcaactccttgacgctttcccaagtgcagtgctggagactgaagatttaactgcagtgagcttggactgtgaggattgaagcagagccaaaaactgacagacagttagtaatcattgcagatgtttgctgaacaattgcaaggtagcaggcactattctacttttcacctgtagaattctgacttatcctcaagatttatcttgaaattttccagaaagccttcctataccatcctttctcaccctaacctctacctcacctctcacactaggttaggtagccctcttttttagttttactgcacactgggtttccagtgtttttaaatctactactctttattctattagatctttttatttttaatctccatggctaggctgtgaattccatgagggcaaagactatgactattgtcttgtgtcatagtcaaatgacgtctcctttgcccagggtgtgttacattctcaatgtgtatttcatgaaagaatggatgaataaatgctgtctcccactagactgtgagttcctcagaggcagaaattacacttttcccatgtttttgtgaccctggttcaatatatatgattgatgaaaaagagcgtttcagcaattacagtttttgtttgttcggtttttgttttttgttgttttgagacagggtctcgctctgtctccaaggctggagtgtagtggcaccatctcagctcactgcaacctctgcctcccggattcaagtgattcttgtgtctcagcctctcaagtagctgggattatagacgcaagccaccatgcctggctaatttttgtattttcagtagagatggggtttcgccgtgttggccaggctggtctctgactcctgacctcaagtgatctgccctccttggtctcccaaagttctgggattacactaaactcgtgggaggcagagaagcaacagctaacagaagtggggaggaggcactgtaacaattacattgagggccatctttgtttaacatcagaagattacaggataaaattatttgtcatgtagtgagccaggggtagaaatcctgttttaaaactgattttctgtggcttcagcaaatcatagaattatcagagcaattacccaaagctccagtggaaaggaagagtcagtcttgtttgcatacttgcctggcctagatcttttcatgatctttctgccaccatgttgctgaagaaatcttcactccctttgcctgtgtgtgtttgggatgcaattactgaaatccttcctgaattctgcttacgtgaaatgttactccatgtggttttaattccatgaagatatttcctccagtgtatgtgagttatataggttgggaataattagaaaaagagatgactgggttagaaacaggaaagaaaaggaaataaaatgcaacaaaacaaagcacaaagcaggcagaacaggcagaggtcctgcaaaagggctttgggcaatggaggggagtgctgagagccagacgatgtctggacatgcattagagggggtgagtgcaggcctttggggaatcttcctctgtccctgtagtcacactgtccatcaaaggtggcagacaggccaggcacagtggctcacgcctgtaatcccagcacttcgggagcccaaggcaggcggatcacctgaggtcaggagttcgagaccagcctggccaacatggtgaaaccatgtctctactaaaaatacaaaaattagccagtcatggtggtgcacgtctgtaatcccagctactcgggaggctgaggtatgagaattgcttgaacccaagagccggaagttgcagtaagctgagatagcgccactgcactccagcctgcgggatagagtgagactctgtctccaaaaaaaaaaaaaaaattgggggacagacagaccttcactccatcaactcaaccaggaatcttgtggagaaaccccctaagaagaaaaaaaaaaagcaaaggaacatgtctctcagtgggtgtattacccacgaggaacgaaaatgaatgtacgggagtctggttggaacagacagaaggggagatcctgagaagattcttccagcaaaagatattaacaggaaatgggcttcagagaacccagtacatgaagatgtgcaaaatgccttgtatagccttttttagtttgcctttattgctgtattgtaatagatattaaaatagatatttacgaatgtcttcagggtgagtcacagctcttgtttcccagccctccctttctcaagtcttccattcctccattgcaagttttccagcacagatattttccgaagctggattcctgtattggggaagttgttctgcactttaatcactgacttgtacctacacaaggggagaggttgtaactcggggagctaatgtaaagagaagctgtaccattcaacatatgtatatgaatgttgtcatttttactttacatgcatttatttgcttacagaaaattgcatagtgcagcaaatctataaaaagtcaagctttattgtcaagaagcttagagtgaccaaaggcaaagggagacccataatatgctcattactgcttacacttttaactcaatctaatcatattcttatgttcgccacatgtacacattaaagaaaatgtcagtaattactgaagaatttaacataacgaatccatgtaaaaacaagggtttaattacagcatttacacaggttacaaactctaacatgcctttgtataagagacaatcagatccatacattttgttttctaagccattttggggagaaaaaaaaaaacagcccttgatatttgagtcatgcgaatactctggggttccaagatagtactctggcatttttcaacaaggtctttttcctcactatggagaaagcgtcagtctcagagttcacagtgtgtagtcacatcactgagaaatgtgcatgcatctgacctcacaccgggatacttctccctgtgtgaccagttccaaagacgtcttctcagtttagttccaggacaagctaaagtgaaatgttgactttcagtttcatcaactgctgatgttgaccgcactccaacgatggaaagagtttgaggtcatcagcagttactgggccagggagcctattttcctcaggaatccaagagaatcaaaccctcagtatggaccaagaagcaatatggacttatctgatctaccagatgaaaagtattcaaaattggctttaaaaaatagtcaatttggttctggaaataaattgtgagaatttctgtatctatttctattatcttaaaaagttggcaaatatctaagtgttactaatattgaacatgtagactgattctggactccccactcaggctgcatgtcagagatttgcatagcaagtgaagtcactggtttcctgagaaatgtgggccctgcagagggcagaggagttcccacagccccactcacaggatctcttgcagctattgttaaatggcacagtcatcttaaccatggcaagtgaattcaaggattaaattgtctacttttgactaaactaacttcacaaaaggttaagtgggttaaaaaatttcctacaaagaaataccaaatttagataatatgataattcaagaacaataaaatatcagagctacatttcttcaattagttgtatatactcttgtcaaccacgtagcaaagttgaaaacaatggcaaggagtcagccaaaaaattctacattatcatcaggaaagcattttgaaacataggttatatccattgtcatcaatgtcaactcactctaagtgcatattctaactcaagatttgaagttgatgatagtattcaggaaacacgtacgatttgattactcatgctcaaagccatgtgttattgaaccagccactttacaaaatttaattaaacttaatgatgaaaattaaaagtctctctgaaagatcttatcaaagagcaaaagacaaaagccacttactattgggggaaatgtgttccttataatatgcaagcttattttcccatcattttgatcaaaacagaagaaaaaatatatgaaaacgtataataacaagcttaataaataaaacatgcaaaaatatggtgtgttacttattttaacatgaatttctaggtatttacagttatctgaaacaaatataaaatagtttggatccttgtgatcggtcacaaacttagaaagcctgctctttacatgcagcaaacttttaaaatttttgcatataacaagcttttaactgattaaagtaatgccactctagttatttatgaaatacatcaaaaaggccgggcatagtggctcacacctgtaatcccagcactttggaaggccgaggcgggcagatcatgaggtcaggagatggagaccttcctggctaacatggtgaaacccagtctctactaaaaaatacaaaaaattagctaggcatggtggtgggcacctgtagccccagctactctggaggctgaggcaggagaatggcatgaacccaggaggcggagcttgcagtgaattgagatcatgcctctgcactccagcctgggcaacagagcaagactccatctcagataaaaaaaagaaaaagaaatacatcacaaagtagatggtattttatttggattgatagatttatcatttataaatgcttttctgtagtattcattttgtccataaagcacaaagatgctaaatcatacacaaattcttccaggtacttgtcaagtgagttgatttttgttttctaactatgtagaaagttaaattcatcagttgcttttccagacagacccatttcaggtctcttgactaccatcacctatgtgagcagaaggattcaggggatccttggtggactgctgaagaatgaagcatgtgcacccactttacttctacactttggcagctgtagaacagagacagtggtggtgcaggatacatccttgtatctgggaattaattcctttccgaggtgtatactacttagctttgtgactaaaatctacgggcttcagtttcctagttttgctaaattggaaacatgttaatatctatgactgtagcacatcacaagtaaagataaatgagaaaatgtatgctttggctgggcatggtggctcacgcctctaatcccagcactttgggaggccgaggcaggtagatcgtgaggccaagagattgtgaccattctggccaacatggtgaaaccctgtctctactgaaagtacaaaaattagctgggtgtggtggcgggtgcctatagtcccagctacttgggaggctgaggcaggagactcacttgaacctgggaggcggaggttgcagtgagccaagatcacgccactgcactccagcctggcgacagagcgtcacttcatctcaaaaaaagaaaccaaaaaaacaaaaaaaaaaaaaaaaaaaaaaggacaatgtacgctttgtaaactttaagtctgggagatggctaacattatgggggaagacttggccaagacagctcagaaaccacaaggtgaataatagcacccagaacagaaggtccaccatgaagataaggacttaatctatcaggaaggattaaatgtaaccgtcaagagtaggcttgatggaggagggtgaatctgaatggagccttgatctacagtggggtttacagcacaggcaaatcctggtgactgcatgctagatgaaaggaattggacaaatgagataactgaggcaagagaggttgggcatgttcaaattcgtatctgtattgcatagatagcttaagaatgaaatagagccagaaaaaacatactaggctcagattacggaacaagtttaatgctaggctaagaactgtgttctattatatatgcaaagaggatccatgatcgctttttgagcagaaaaatcacccaacttaatgtgatgttttaggaagatacttgggtagcaatgtgaaaaaggcactgaagcaagcagattgaaggcagatgctacgtataagaccataaagcttttgcactggatttgatcagttgcaatgaaggcttgagtttggatggtggtcttgggaaagttcaaaaaaaaaaaaaaaggagaggaggggtcataactgaaagccattttatcatgactaagaagtcaaacatgttaataacctcaagagatattggaacaagcagaaaatattcctcttttgtgcatccatacttttattaagaaaagcttaacggagcttgagatatttatagaaaaggccagtaccatgaggaaggagatgtgttcctagaacacgtttaaaatgatagtgttctttaattttaaaatatgatggaggatagttttcgaattttgtgtcgcagtttttgcaaagttactaaagtttccaaattctaaaaccacatggtagtctgccagctacacatggagcaaataacctgccctgatgctccccacttgtaatccagccagcaagccctgtctctccattcccaaggctgtgttcacagacagcattgacgaaaaccagccagttcccccaaaacccctgctgcacagtatctgacagatatcagtgatggcttatcttcacttgtctttcaacccctctttattctctacccctctttatgcaccccaaaactgccaatatctctataaatagcatgactctggctttcctgggcttgaacttccatgtggatttggctgacggagatcaatgtaaggagatgggatgctcagaagacagagagttgggggtaattttctcccactccttttctgcagtgggaactgcagtgatggcaacagtattctctccatgaaaacactccctgcctcctgctatggtttcaatatttgtgtccctccaaaattcatgttgaaacttcatcctcagtgtgacaggattaagatgtgaggccttgaggaggtgatcatatacccttataacagcactctaggggactagctagatcctgtttgcttttatattccttctgcaatgtgaggacacagcaagagtcgccatcttggaagcagaaagcaaccctctccagcccccagatctgctggcaccttgatcttggacccacaactgtgagaaatatgtttttctcaatagactacatagcctccatgtccatgttctattaatgcagaacaaacagattaagacatcccacagtttgggcattgaccagtgccctctttgcccacctttgctgctggtagcctgtcttgcagatacccagtggctttacagaaggggaggtggcttcctggatgttctcacacagtgcgagctgagagatggcgtgctgcaggcctggagcactcctctccagcatgcagaatgactgtggagcaatgaccaatgtatgactctgtctcttgtgtgaccatgtgctccagttttcccaggacataataataataatttctaacataattattaacaacaacccctttcaccgtcaaaagtgacctgacttagataactgaattgtaagttcactccaccttttccacaaagccagaatactagaacacacggtcagaaaacaaaagggtgaaattgggtatgacctccctcagtcttacactgatgggatctgtatttttcattcttaattccttatactcagtgtgttgtgaagtcctagggccaagggaagaattttgcatcaagaaacatagtcctggtttcgttcaatgagaacctgagactgttctataatcatgttgggcttttcatgttacgagatagagaattcctattttgaactggcattttacagtgccgaaaggatgttggagtgtttgtatacaatgggagcaaagaagattacatctagaacatgggcaacttactggagctccttaattcactagtgtccaaagataatggttagtgggaaactgtagctgtaaaggatttgcagtctattggaatgaaaattttggtcatactactagtttaaaatttctgacagggaaaggtgttggtagaaggtaaagggagtattgataggtgatttgaaaaaatgaaaaagaggagctgactatcaacatagaacatagaccaacagcagaggcagaacctatatcagctattgtttacttgtgctgattaatgccttccttccctttatcatgctgtctgatctgaagagtactggtggaactaacattacaacctaggttccaggtaggggtatgactgagttgataccagcccaccaccatacagtggcaggtgccctttgtaagtaaggaggatagtaaatgttatcctccttactctaccattgcactgctaagtaggcttttattttgctgtatttgccacctttaaaatttatccttcgcatcgtagtcataacaagtgaggtaattaatgaggcttccttaccttcactatctttcttcacctttgacatggtaaagtttattatttctatgttattggggcatatgacatttccagcctattctgtaaccccaatccacatttggtttcagtctacagtaaaatacattcaatacttacaactttttttttttggctgtattttaccaaagcatcttcctttaattggttgttattgttttccttccttctgtaaccaaatgtattgccctttttctccacatacccatgtttttgttctctcaaaaacattaatgaaaatattttttcctgaattcttgcttgataaaaaccgcaacaaattgtaatatatcatgtctgcatagtaagactagcttggctgcacataaaaatccttggttggcattgagaatcttgttggtcttccctcatgaccatccagcttcagtacagctaggggagccaggacagccttcttcatttctcctgtgagtgacttattctttttttctggctgcccaatagataccttattttttttaagtccaataccttcattaagatgtggttcactttttgcctgtcatgaatggatataccttgcttctgatgtgcccttttgaaaggtagattcaagtcttcatgcattgcacggaagtgttcttgaattataattttgaagtattcgttctgtctcttttggtttcttctttggatgttccagtaatgtatgtgttcaatccatttgtcggtcttccatagttctcattttctctgtaatacttgagttttgcttttcagatgtttgcttagataatttttgtataaatgggtatccatttccttttatttttgtaatatactactaaatggtttgggttttcctagataactacagaggttcagagagagaattaagacaaccttctgggcctcacaccagaatggctctttcctactgggctgtcacagagacagactgcttcctgcaagtatggctcctctggtgattctgtgtgtggttgaatctcccttgttcctcccttgaacaaaactgggtccaggaggggactttttctggtagactgtgtaccctggttcccactcctgtggttaaaaaaaaggggtataagttttgaacatggaagtgaactcccaaattttcagggagtacattttgttggtgttttctgagattatcagccattggcctcactacctccatacttcatttactcccatgtggcttgtgcctgattccaactagatttagtcatccctacatatgttttgaaatctttggattctaactttttctagtttcactaaggatatatttggttctttttttctccattttccttgttgcttttttatgtgttctggaataatatgaggaaaaatgctgacttttacagcctgtgtatacaactacctctacagaaaattttaagatatatattagttatttatattcacacaataactttgcaaatagtcctagtgtacaaagcttattcctatatcttgctgtgtttttaaacaaacatatatacatatatgctgtgatagctgatgttgagtgtcaacctgattggattgaaggatgcaaagtattgttcctgggcatgtctgtgagggtgttgccaaaggagattaacatttaagtcagtggattgggagaggcagaccctccttctatctgggtgggcaccatctaatcagctgtcagcacagctagaataaagcaggcagaagaagatggaagaacagacttgctgagtcttctggctttcatctttctcctgtgctggaagcatcctggtctcgaacatcagactccaagttcttcagcttttagactcttggacttacaccagtgatttttcaggggctctcgggcctttggccacagactgaagactgcattgtttacttcccaactttcgaggttttgggactcagactgatgcaccactggcttccttgctcctcaacgtgcagatggcctatcatgggaatttatcttgtaatcatgtgagttgattctctttaataaacccccttttatatgtacatctattctatcagttctgtccctctagagaaccctgactaatacacatgcatacacacatgtggtcatgcagacatgtatacatgcatgcacacatatgtgaccacatgaacatgcatacacatatgtgatctttgccattgtggatggctaggatgatttttctcaggaaaggtatctgtgttattagaaaaatagccctggttctcatcctaaagtcataaaaatcaggaggtaactcagtaaaaggagacacacacacacacacaatgttatatgtataagtgatttaatattttatatatataatcaaatccttgaaattgccctttgtattaatcagggttctttatagaaacagaatcaagagtatgtgtgtgagtgtgcgcgcatgtgtgtgtgtgtgtatatatatacacgtatatatttaatacgtgtgtgtgtgtgtgtatatatatatatatagacagagagagagggaaagaaggagagagagggagtttattataagaaattggctcatgtgattatgggggctgaaagtctcacaatctgccatctgcagctggagacccaggaaaggcagtgatgtagttgagagaaccaaagtatcgatggtataagacccagtcaagaacagcacagggggctgatgtgtcagctcaagcagttaggcagagggtgaagtcacccttcctgtgctttctgttctattcgggtctcaatgaatcggataatgcccactcacatggtggagggccacctgctttactcagtctgctgattcaaacgctaatctcatacagaaacagcctcacaggcataaccaggacccatgtttagtctgggcacctcatgtctaagtgaatttgacacaaaaattatccatcatacccagagttcttaatcaaagtttcaatgactgaggccagtcctgggccgctaatgttcatccaatattgcgtctagttttaccatcccttccgtttgccagaaatagaaacagaaaatgttctacatgtttgcaccaccaaataatgaataagcaatcaaatgccattttgattattgaccttctagcttttacaaaacacaaaacttgcacaaataaagatactattggaagccaaggaacctagagacacatgtaaattctctttatctctgctcgatgcgtaaagtattcctatttaagagtaaatttcctcttgtttcagtgaaagatatttttaactgatatttttaccttcagcaaacacataaacggtgaaagttatcccaaacattgccattttcaatttccaaaggagcttatgctaatttcagaggcatctctatggtttatatgtatatttaatatataaggcaggtcctactatctctattttacagaagaagaaactgaagttggaaagatcaacaagcttacctgaagtcacagggcaggagagtaaaggagcagaattttcaacctaagtttatatgattctaaaattttccactaccatgctactaaaagaaattactcaactagttcttcctgttcaggtaagtcagttcagactttgctaattctgaataaaggggacagaagttatgatgctgtaactatttgacatagactgtgttagattagagatgagaggcaaaaatctgaccctagtatatttgctttcattgattccaatgtcatctttaggtttttgtatatttctttctgattttaacatatgatcctttattttcttcttactttcctcccttcctcctctctctgtcaaattgttttcctcttcctcctcttttaaaaattctcaaaatttgactataaattgctttttcttctttgctccttttcacaactctttcattgccacaaggcattcaggtagaaaaaaaggccaaggtagtctgcagtgtgctagctatttacccaattgacccaccatatcttttacataagcaaataaattaacaagttatgtaaataatttatattcaaatattcagaaatgtcttagacatgtttaacatgctaccagtaaactccttttaggaggagaccacatgcagctttagaatagaaaatagaagaaaggaaaaaaataaacaaatgaaggtttttctctgcagtctttatgcaagcaacgacttttttcttaaactctcccctttgtggctatcactcaaagaaaataaagaagaaaagctactggctttctagtttaaatcacagtctcattattctgtaggtgaatggggagggggattggaatcgtaggtccgagtgggcagtaacttgaagtcaatggagatatttacaaaacagaagcacaatcacgatccagcagttctggagctgctaactttttctgcctttttctaaatgtccaataataaggttctaatggagactgaagatccatcacctgctccacatctccagggggcccatgtgtgcatcgcagtgcagatcatacatgcttctttcccctcccatggcaaggggaatactgaatgatgacagctcacatgtgtaacccaagggctttgcttgggtttgcaaggactagtgcacaatacattctttgagtgttataatagcattaagtcaatgcacgaattataatccctatttcacaagtacaaaaacacattcaaagaaattaacttccttgctcaccaaacagttattgacaaaaattacaatatttatgtttcttttgaaaaatattataaagattctcaaattgtctaaccaatcatattatccgtatttgtctcttctcaagctgctaataaagacacacccaagactgggacatttataaaggaaaaaggtttaattgactcacagttcggcatggctgtggaggcctcaggacacttacaatcatggtagaaggggaagcaaatatgtccttcttcacatggcggcagcaaagagaggtgggaaaaaggagggaaaagccccttataaaaccatcagatctcatgaaaactcacttactatcaggagaacagcatggaggtaactgctcccatgataaaatcaccttccaccaggtccctcccatgtcaggtggggattatgggaactacagctcaagatgagatttgggtggagacgtagccaaacatatcgttatcttgataagatattgctttggattgaattgtgtccctgcaaaaatcttatgtataaaagttctgatccctgatgtgactgtttttgaagacaggcagggcctttagtaggcacttaaggtcaaattaggtcatacgggtgggacctcagtctactaggactggtggctttatactgaaagaaagagacagatgtctctcccctcgacctcacatgtataaaggccacataaggaaaaagcagcccaagccggtaagaggccccaacagacaccaaacccttccagcttcatgatcttggacttcactgcccccaaaactgtaagagaatgaaattctgctgcttatgccatccagtctgtggcatttagttacaccagcctgcactggctaatgcagatattcagaatcaaatgagtcatcccaagcaatttctcagtatatacagcacagatttcaccttctaaactcacccttgtcttcgccttttttttttttttttttgagacggagtctcactctatcgcccaggctggagtgcagtggcgcgatctcggctcactgcaagctccgcctctcgggttcacgccattctcctgcctgagcgtcccgagtagctgggactacaggcgcccgccaccacgcctgactagttttttttttttaatatttatatttttagtagagatggggtttcaccgtgttagccaggatggtctcaatctgctgacctcgtgatccgcccgcctcggcctcccaaagtgctgggactacaggcatgagccaccacgcctggccagtttttcttaattattaaataatctttcattgatttaagaaatattttcttatggttcctattcaggcccaggcattgtttttttgtgctgcagacaatgtgttaataaaagctgtccagccttgttagtacatcatgatatttatatctgacaaatcctctacttagatatgtatcacctccataattttttggaacacataaattttttgaaccaaatggaataaaaagctagatatatacgtataatgaatatatttgaaactttgtactttgctttacaatttgcaaaagaacatcatatacagtgttgtatttgagtctcccttaagccctattaagaagaaatttttctatttctgctgttcagtgaagaaaatgagcaaaaaaaggtgcagcaacttcccaatatcccatatttacaaacataaaggagtgggactttaatgtagactcttggtgtccacgtttgtgctctttatgcttcatgacaccaggtaaagtgcaatgagcacagcaaatgtgccccctcaggagccagctaagaccttccgggggcttctcctggaagtacagagtctgcgacccccatcctaaatacacaagcattggcatcactgtctcacagtaaaacaaaacaaaacaaaacaaaaaaacaaaaaaaaaacaaagaaaaaaacaaatacaatctgttcagcagagtaactgtacataacacaaaagaacttctgggaaaaacacggaacgcatattgaagtcagaggctcagtcatgtgaaaataaaaggtcttgttgggtgcctaagtcttgtctttgctaacagctgttttcgtgcaataccagtaaacccagccaaaggcattctagtgagcaacacaggaagactcctatacacttcaattttccagcaatccataaaattgaaacataaaaataggattctatttcccttgttcattctatatcttaccagtacttatatttgcatatgtgtagaaactcaaggtttacaaagcatatccacggtctttattgtatttgatgctccacaaaatgttgcaagggactcagacaaagtcttgtttgtactatgttacaggtgagaatgctgacatgtagaggggcaagtacttacctgatcacgttgtcttagtatgatgaagcctcacttaaacccatgatctcatgtcttcccttaaactgatgcactgaaatacagtcaggtaaaataaagagttaggggcacattttaaaatacatttaaggtgcatcaaagatttaaaccaatcacttgtaacatctctatttgtcaaactcattggtgatcattagcatttagagagacccaggacaatcgcaagattctaaataattttcaaaccatagtagatgatactttgtttactgttatttatgtattaaatatcttttaatatactatagctttataagaacagataatccatttttggaatttgtgttttaattggccaaagagttaaatccattttttctagatcctctggataattaggaatcggtagtaaaaagcaattgcacttttccaataaaataatatgctcagttgttcaaacccacattcttgataaaaacaactagaaattctgcataagatagaagaaaaagaagattttggagcaacaaagagcatacaagatggtaaggaattacaagaccaaaatctaagtgatgtcttgatctcagaaaagaaagctaaatgttgaattccctttggcccttggagaattcatgaaagcagtgaatttgagcttcagtttttcagtctctgtggagtgatatggaagaaggaaaaaatctcaagtccccagcaacacgcatgtgataatagaagactttccccctatgaaacaagacctccaaagagctataatttcacaataagcataaaccaaaagtaaacccacactacctcactccttcttctatgtgtcggcaaggaagtgttcgttggtgctaaacaaagcatggggaaaatgctgctgttgcataaattacaatctcaaaaactcaagctataaatttagtttaaaacagttcacaatacctaatagaaacaaatgtgcagttcctcctcatcctgaaagaatctccacaataatattccaaggaaaataatgcactcacagcgtatgtatgtatcacctatatgatgaatatagctgatagataagtacatatgtatcatatatatatatatacatataaccattacagagaactagaagaaatagtggagaaagaaacagttctacaaagaccctagatttaaaaataatcagagaaaaatgttgtaaaacaactcttctcataacgtccaaagctagaacacacttgaaacaatctcagcaaaagaaagctgtcaaatatgcagccataaaaaaggatgagttcatgtcctttgtagggacatagatgaagctggaaaccatcattctcagcaaactatcgcaaggacagaaaaccaaacacggcatgttcttactcataggtgggtactgaacaatgagaacacttggacacagaaaggggaacatcacacaccacgagctgtcattgggtaggggttggggggagggataccattaggagatatacctaatgtaaatgacaagttaatgggtgcagcacgacaacatggcacatgtatacatatgtaacaaatctgcacgttgtgcacatgtaccctagaacttaaagtataataataataataataacaataataataaaagaaagctgttaaagatgaccagcatagaatctctcttccccactgtcagacaacatttcagtggtccctgtaactattgctctggtcctgaataagatctttctcaccatgcttgaaaaaaaaaaaaaacagaattgcaaaatatgtctctgacaaaggactaatatcaagaatctacaaggacctcaaagaattcaagaagagaaaaagaaacaaccccattaaaaactgggcaaaggacatgaacagacatttttcaaaaaaaaaaaaaatgcaagcagccaacaaacacatgaaaaaatgctcagaatcactaatcattaaagaaatgctcattaaaaccacaatgagatatcatcttatatcagtcagaatggctgttattaaaaagttgaaaaaagaaaaaaacagaggttgacttggatgcagagcaaagagagaacgcttatacactattggtgggaatataaattagttcaagctctatggaaaacagtatgaagatatctcaaagaactgaaaacagaactaccctttgacccagaaatattcataactggacacctacccaaaggaaaacaaatcattataggacaataccatgacaatagcaaagtcacggaaccaacctaagtctaacctatgggtccatcaataattgattggataaagaaaatgtgatatatatacacatcatgtaatactacaccaccataaaaaagaatgaaatcatgtcctttgaagcaacatggatggaggtgtagaacattattctaagtgaattaactcagaaacagaaaataaaatactgcatattctcacctacaagtggaagctaaacaattggtacacatgggcataaagatggaaataatagacactgaggtttcccaaaggggagaggatgtgagtgttgaaaaactacctattaggtacaatattcattatttgggtaatgggtgaactagaagcccaatccccaccagtatgcaatatacccatttaacaaacattcacatggaccccttgaatctaaaataaaataaatattttttaaatgactggaatgtgtgaaaaaggaaacaaagaacatttctaaaatagaaagatgcaaaaaataaatttttaaatgcaatggctgttcactattttgtagtagctaaagtaggtactagtgaatccaaagatcagtcagaagaaattatgcagaatgcatcacagcaaaacagaggcagtgagacattttaccatatttttacttggattcctaaacaaagaggagaaagaacatagaacagagaaaacgtttgtaagtaatattttaagataatgactgataccctacatcaaaagaaagccaacgggaagttcctaaatctatagagggtacacaaacataaaactacacttgaacatgtcatggcgagttggacgaaccaaaaacaatagtaaaaccaaagaacaaccacacacatgcataaatccacaaggtagtgaataaaacagcttactttcaaggcagcagaatggcattgaccactaactactcaacagaaatgatgaaagacggatgccagaagaatcagatcaccaaagtgctaataaaaaataattgccaatctagaatttctaggacccactttttaagagtaggatgaaatgcagacattcttgggcaaacaaaaaaagagagtttatctgcagcatatcctcagaaaaggatgtaattaaatcagagaaaaagatgaggatcaagaaggtaggaaacatgcaaaaatcatgacaagtagtttttgccattaagaaaaagatgaaactaattaattccacaaaacaagtcaagaataactcgtgaattagagggagcagaaatggagttgccatcttcaaaggccctcattttcaggagatgtatacaatttttggaaaaacttgtatttgaaaagttaagtatgcattttgcaattttcagagagtgaaagaatagcaacaaaatacttataaactaggaaaggaaaaatcttgaataagaaaataatctaaccaaaaaagccacatttaagtactatgtttattttgttaaattaatttaaattttaaaaaattatcttcactctatgcaataatatttgtgaaattttgactctggtgtgtaaattaacttgtttactgcattgaatcctttgtcatttttgtaatactttgattatctccatctaaatattcaaacatcacctcttaacataaccagtggtacactttccatgatttagatatggtggtctgactagcgttgaaacttgagagaagctagcctcaataacaggacccagggataaccatctagttctccagcgaagggccttaagccctctgggggtccaccttgttggttactcactaatcaaagatgtgcccggcccctagttttctcctccctgactcaagttcatgtcattcaactctctgcctggttcacggactcatggtattctgccctactcctgctgcttggctatccaccagttaccaaaagctgaagttgatgcaaccacgtgaaatttctacaagaccctcccctctttgggctcccatcacattgtcactactgccagatgtcatcagcgtgagagaatcagtggtggtccacaggagcatcttgttgtccctccctaaatgataccagcaccactttcctcccaaaatcaatgctcccaaccacaataccccccttgacttcacttgtgttcccagcaagccatcaaaactagcaccaaggctctctctaggaggctataaatatgtatgttttccttttttctgtctttaaatggtgagttaacacaaacagacctacgtacaccagaccccaaggtatcaatctggatcccttcacaggatccttttccattcacagaaccaagaaaaaaaagcaaactctgaagcccagcccttccctcctctattccggagcaggcagctgatgggacgcaaatggggctgctgagcttcagggtggaaatggaagccagtgccttgtgctccttgtgatgtgaaacgtgttgcagctgcacagagaaacaagagttttcactggacacagtgcaaggagcaagcaggatgcctttcatggacagaagctgcatctgtctatacttcagccattcaatcaacaaacatttcatgatcatcagttactgctatgaaaggtagatgctgagggtaaaacaaggaacaagatgagaatgccccactcccatatggcacatgtaaaagcataaaagtctatctgaatcatttttgaaacagaaggcccatgacattgcctgctgagtccacgttggctcttgtttgtggataccagcacatattaaaattatctgaaatattcagttgtgagccccctcccctgatatggttaggcttcgcgtccccacccagatctcatcttgaattgtaatccccataatccccataatccctatttgtcaaaggagagaccaggtggaggtaactgaatcatggggatggtttcccccatgctgttctcatgatagtgagtgagttctcccaagatcggatggttttataaggggcttcttcccctttgcttagcacttctcctttctgccaccttgtgtagaaggtgccttgcttccccttcaccttccaccatgattgtaagtttcctgaagcctccccagccatgctgaactgtgagtcaattaaatctctttcttttataaattacccagtctcaggcagttctttattacagtatgaaaatggactaatacagtgagaaaaaaatagctctggagggctgggttacattcaggacatgtactaaatattttaatgcattttttttagcaagcacgtaaaatgtctcccccaaggctttaagctctctttctacttccctaaaggtttccccatcaaaataggaaataaatattgaagctagaaaaggcttgtccccttcaaagtaagtaagggcacgcttcatgacaggcatatctttcttcagacagtgggggaggacacttaattccttcaccaaagaaaaaaaaagttacaaaacagcaacctatggaaacaaaaacatggaatcaatgcatcgcctgaaataacttctctgtagtcctgagggtggtgttttgtttggcttgttctccttcccacctttttataccccccaaggatccttctcattctgttgtagccagggctcctagagaaggctgtcaacattgaagggcccagatcccttctaccagtttttcttgtgcttcctatgtgcttgtaactgtgaatctcctgcttttcaaacaactcttctgccttttgtatgggtatacattaaaggggaaaatcagggcctcttcacactactctggcaaaatcaacctgaactgctggattataggtcttggcatctggagctgcctgcttgagccctggcaggtctggaggcttggggctctttcattgactcaggaaatatttctgcttcccacccaggacttctgttgtctcttcctcccttctcctcccctgctctcaggactcttagatgtagcccaggtttgcttccacacagttgacattggcggtgcatggtcttctcccctctacgccctcagatctccacgcctgtgcctatgacacgtgccacctgcacctgtgtagccaagcctggctcctcatccgtggccactcctgcccccacaacctgccagtcctgcctcctttttgcctgcctcctgcctatctttacttcactgatttctttggctggaaaatatttctacaacttcccctcccacactcacctggggctatgacattgttgtgcacactggttgggcctcgcccctgccacctaacaagtacatcctacaggcccaggagggcattatctgtggttttgaatttctagtgtctcgaactgtactggcccagagaggacctcaaatatggaaaactgaagtgattgctttctgcacgcgttacctatgcacccatgcataactcacacaaacttactgaatcttcatttactcttctgtaaaaggggagtaatcaaagaaatgcactttactaacaacaagaggatggcatagtttatcttttaaactgataaagatgttctgaaataagaatctatgttttcaagggtacaggactttggtagttacaccatgacagtaaagatgcatattttaggaacttggtgggggataatttgacaatacacatctacatgtttacattgtacataccctttgactgacactccactgttagaaatttgtactaaggaaataatcagacctacaacataagcagttagctataggaatactggtcaaagagttgttgatcatactcaaaaattagaaacaatctaaatatgcaataagaaatatttaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaacaacaaaaaaagaaatatttaaaataaattatattgcattcatctgatgtaatattatacagacatttagaaagctcttatagtcaaaggataagtaggttacctttggcatattaaatgagtaaaactgatactaagttgatatacccattgtgatataattttctttggttcttaaatatttttatatacctaaggaaaaagattaaaagcttatgaaaccaaaatattcacagtttagttatcacagtctagtgtgattatgggtaatttttattgttttaatttcatatttttctgttcaaagttccattgcttgtttaattaaaaaaaacttttaaataatattataaaatgaccatcacagaaaaaaatatcattaggcaatattgccatgactatagacctttctccctacactgttattcttacagttggatgctttgaatcgggaagtgatatatcgccttgcttttcgctggagaaggaagcgccagcctttgtgagcatgtgtatcacaagctaactagcacgaagattgcatagctctttctacataaggctactgttcgcagaaatttggtccatggtctccagtctcttggggtctcacgctctgtgaaaatcttcgtgtttttccctagcccccagagtcacctttcacacagcgtctgcttgtaaccgcggtccccacaggagtttgtaggatttctgtgccagcggtgaaggtgttctcacctcatagagcaaggtagaaactacgcagacaggcgctgttctttgggatgaaagcagggcctttggggctctttcttagtgtccccgttcggttgtagacataacacgcttgctttgtgtaggagatcggctctgccggcgcccaggggccctaacgcaattcatcgaggcccgcaggtcagaactgcagtctcacctgtcttggcggaaatgcgctgcgctcctccctgtactacataagcacgagaattccactacagaagaaaaccccaggcctagtgatggcggttctgggcattttgccagcttctcccagggtgtgttttctgaccccacccacttctgatctgtaatgtcatggtcaatagaaactacttggcccaaacggaaaaggcaaggaggaacacagcgggaaagcctatggcgttccctggtggctaccccggggactgcactcatagatccgcgtgttccgagaagcctctgccatcccgaccccggagccgtgcagaaacccgcggctccaaagaaaaccggctagaacgcacaggaagcccagccagtgttcaggacactgcgagtggaagccgtacgtcccacggactgatctagtttgctgaagacgagccatttacttctaaccccagcagcggacattgccttgctcaaatataaaatatatgaaccaagaccgaaagcaactcttattgcgttactgatgagcaaacgggtttttagaatggttaagaaatgtcccttgttttgggaccgtcatcactaacgtatgcttgggattcctgatcgaggagtttctgagcaaagcagcccaccaatccagtggctgagaacggcttggatattggcttccaggcgcatcagaaataccgaggttctgacaaagacgtgagcttctgtctgcctttgggaaggccttcttccagtcctggcgctgccgcttgccttctgtttgacctggggccaggtccttcaatttgctaggcttcaagttggaaagtgttacaggaaaataataatacgaagtgcttcttagagttattgcacagattacagaagatagtctaatagtacagctagcatcctgtatggcttacattaaggatttgctgataggaaacaacatcccagataaagttttttccccttaattatgaaatataacaaaggaaagtgtgtagacttatgcttcaggcctctgtaacatttgaatgaattttgcacttgtgaaggtgacatcattttacaaaatcagttaatactaaagaatgacaagtggaatttacaaaacatatattcacaaaaagaacttgttcttagcagctttgtttacaatagtccccaaactggaaaaggttcatatgcatcaagaggtgaatggacctattgtgatatattcatccaacggagtactaccctcaataagatgggacaaattatggaaacatgagatagcatgggccaatctcaaaaacctcatgctgagtgatgaaaagagtggattctatgtggtgccatcaaggtgaatttctagaacaggtgaaactaacctgtatagtggcagaaaatacatcattaattgctggggtcagggagtcgaggggactgactgcaaagggcacaagaggaccttctggagtagtagacatgtcatcaaacttgaaatggatgcattgtaccatattcaaccaatgccttaatcaatttgattgtaaaaagtagtaagaaaaccactgcaggctggacgcggtggctcacgcctgtaatcctagcactttgggaggctgaggcaggtggatgggaggcggaggtcgcagtgagacgagatcgagccactgcacttcagcctgggcaacagagccaaaaaaaaaaaaaaaaaaaaaaacctccgtctcaaaaaaaataaaaaaaaaaacacagcaaatcataatgcattctacttaatttaatgtatgtttagctttagaggattcctttagaaaagcgtctcgctaaatgtgattgagagttcaggaattccttcatttctgtttctgtctctttgtcttcagttaaattcatgcactattaaatggaatatttgtaaaataaaaatagagtctaagttcaattttacaaaagcatatatatatatgtgtatatataatatatagctcccatatatatgtgtgtgtatatatagagagagctttatttattgttttttcttttgcgggggtgcgggggggacagtctagctaaaatatacattcttctctctgtagatataccagaagaacatgactcgatcagtgttgccctaatgttaacaaaagttattttgaacttaaggtgatcagaaattttacctatctgtactttttctgtattggtggtatggtctatgctaagcgtgtataattaaaaaaaaagagagtaacttcaaaatgatttggaagaaaaaatatgtacatatgtgaatagtacttaattccaggtgatgggaatatggatgactggttatcttcttctttctgtatcttttatatttttaaatggaaaaactcaacgacctggaagtgaaagaacagatttggaagaggtgtgggcaggtgagaggaaaatgcagagtgaaactctgtctcaaaaaaaaaaaaaaagttacttgtaataaaactcaccaattttaaatctacgatgtaaccatttaaggaggtttgtagaattgtgcagccatcagcagagtcacgttttagaatatttttgtcatttccccaaataccctaaagcctctgcacagtcatttcctaatctctggtgcccatgactgggccccaacaaaataaaaatttggaaatccgacatcattaaatttcaaattttcttagattgggattttttgtagtgaatcattgtcttacttttgtgacgtttgaggaaatattgcattttagggacttttttgatgaacttaataatagtcctgttcattgctcttcgtgaattgtttcatttttactgataactgatagttgctacaaaacctggtctggcaagcctaaatgaatgagctaaaaaaagaaaaaaatctgctataagaaatagagatagatgatgaatttgcacataagattatgtggagttagtattgtaccatctttattctttcagaaatttggttggtaacattacagatactcctcacatggttggaatgcctctcattatcttcttcaggttgcaagggctccagaatagtgacataaaggtaaacgtgagtgcaagatttttgctgtagttctttgctctttaatttttttctcttagagggattagcatccatgtatctgaaataataaatcaagagtagagataggcatctgtactagttttctattgctgcctattaacacatgcaacaaactagtggattgaaaccacagaagtctggaacagaggctgggttctctgataagggttttaggaagctgaatccaggtgtgtctggctatgtaattatgtggagctcaggctacttctccaagttcacttcaggtgtaggaggaattcattttgtgggagttgaaagactgggttttctttttctgtgctggctgtcccaataacagctcatggagtccttctcaagctcccattcttcctgacgttaccttcttctgacagctagagaaaccactggcatgtatgcagtgatgtgattagatccagtttacacaggtaacctcaccatcttaaagtcgtataactggcttataacaacataatcaccagaatgatgtctcagcaccttaacaggctttagagacaagggtgtggcatgtttggggaccatttcagaaattccatctaccgcagttggacactcacattcccccatctgcaaaatacattcaccctctcccctaaggtttccaaatttcatgtcattaaagcgttagttcaaagtgaaaaatggtatgtagaccacaccagatcaaaaatttaaaatcttatcttaatcatccacaccaagtatgaatgaggcttctgagggtgtccttgacataattcccttccctctatcaacctgtgaaactgaacaaacaacttatctgccctcagtgtgcaatggtgggacagacatagaaaaacgattctttttttttttaatttttttattatactttaagttttagggtacatgtgcacaatgtgcaggttagctacatatgtatacatgtgccatgctggtgtgctgcacccattaactcatcatttagcattaggtatatctcctaatgctatccctcccccctcctagaaaaacaattctagtgattcttgttcacaaacggggaaagtggaagtaacaaagaagtcactgatccaaaacctttttgaaatggggctgagcaaagtccagcaggaattgcgtggttaggatccacaacctggaactaaccttctgtgacatggagctttgcctctggagtctgcatttctttctatctttatggcaatcattttattttccttcctctcctactcccttggttcttcccctttctccttatggcagcatcctccccttaatccttggcacatcatccccagcagaattggtcaaatgttgcccacgtcacggtcctgaccatctccatgaggggctgtccttgtgaccccctgctcccctgggaccctcttcactgacctgacctctctgtcatgattgctttcagctgacctggctggtttaggagaaaacctagaattgtggagacccagaaccaatctctgccctctcttatctccaagagaggaagaaaataataggtatcaccatggagaaatgacccacatgagggctgagactctccagcagttagagcagaggaaactccctgaagaagggaggagctgagatctcaggctgggagagcaggcttgtgttaagcattacttaatctttatgtgctccctgcctgaatctaccagccagcgaatgacaactgactgagtagaaatactaggactacagaaccgtgataaaaggtttgtccaaggaaaagcccttttactttatttgttttcacagtggaaattgctgtttttgatccaaagttttctgaaacgctgcagtgagttcctggtgggtgagttaggtgctttggacctggaggctgaggccaaggcttgtgtggtcgatctgctgccaccatgtggtgagggagcctgagagagtcttagtctttcttggcttcactttcctcctcagtgaggtaggggcttattgttcctctctgaggtcccttcctactgtgttttctctgagtctctgaggaactgagatggtttttatttatttatttttttccttccctttccctccttctttcctgtgcccagttgccaatcaagccacccacctttccatttgcgggggaagggggcgatacccaaccccctctattactagggggttgttatggtaactccccacgcgagggctgggtggcctctagataggacgggctgtccacccacccaattgctatggcaacagtggagccgctgagggaggggccactccgtgagaacttggctggagaaaccacgtgggagttggggggcagaggaggggcaccggctgcctcaggaatgccctttccaccctcacctagcaggttggggaagcatcgaggtgctctcagatctcaggataaggaatcctaccgcagacttgtatctctgcacctcttttaacgaagtgttctgcacaaaggaactgtttccacaattattcattgatcactggagtcgcgcgtggaggaaggggtggcgaaggggaagagagggaatctgcgttcagtcccttaaaatattgcttgggttgccttagatctagtcatgttggcatagcgcctacagccattagcctcagtggaggctgggtaatgctatctaagaaccacgagtcatgttctaccactgaaatgctgtgtgaccttgagcaagttgctttgcttctctgaggttttctttcactgtgaaattgaggggggaggctgtatgatcctcaagagctcttctagcaccaacactgtctctgaaagactccaccaccggccttaatataaacatcatttaagagagtttaatttagaagtccttgaaaaatagctgaacacattcctttctggaccctttttagcatttgggtgcacagccagtcggcccccttccctaacccctagcccattttccttgccactgcccttattcaagccgctatccccattcatctcctatttggccttccggcctgactccttcaagtcaattttttttttttttttttttttttttttttttttttgagacagagtctcagtccgtcgcccaggctggagtgcagtggcgcgatcttagctcactgcaagctccgctttccgggttcacgccattctcctgcctcagcctcccgagcagctgggactacaggcgcccgccacctcgcccggctaattttttgtatttttagtggagacgggtttcaccatgttagccaggatggtctcgatctcttgacctcgtgatccgcccgcctcggcctcccaaagtgctgggattacaggcgtcagccactgtgcccagcctctatttttttttttaaagacaaagtctcgctctgtcacccaggctggagtacaatggtatgatctctgctcactgcaacctcaagcttccgggcccaagctatcctccagcctcagcctcccaagtagccaggaccacaggcagtgcatgccaccacgcctggctgattcttatatgttttgtagagatggggctttgccatgtcgcccaatctggtctcaaacccctggccccaagtgatctgcctgcctcggcctcccaaaatggggagattacaggatcccttgaggacaggagttggaggccagcctggccaacatggtggggtttttttttttttttttttgagacagttttagtttagtttagtttttttgtgaatttgtgaatttgtttttattggggaacaggacacagggtggaaaatgtcatcttggtggagacagagttttgttctcgttgcccaggctggagtgcagtggcacaatcccggcccaccgcaacctccgcctcccgggttcaagcaactctcctatctcagcctcccgagtagctgggactacaggcgcacgccaccacgcccagccaatcctttgcattttcagttgagatggggtctcaccatgttggccaggctggtcttgaactccccatctcaggcgatccacctgcatcggcctcccaaagtacagggatcacaggcgtgaaccaccacaaccggccaagcctgacagacatggtgaaactctgctgagatggtttttaatgccacccaggacctgcagctgagacctgactctgtgtgtctcctgcaggagcctgagctgagtccacacactggaagcccagaactgagggaacagatgaaagaaagaaagtcagcaggtttaggggatgagaacaactcacaaaggacaagccattggtaaatgaaaaccaaagaaggggggaataaggacaagttgggatagaagcctcaggggaaatgggcaatgcctgcctgtcatcatccaaactctcaaggagcagcgcgagctgagcagtggggactgagagagaaatttactccacaggagtctcctgcccctggccagggagagccacaggctggatgacatctggtttatagtgaggggcagcagcaactccaagagggggaagatgtgaccatgagccccgccccagacccaggaggcttgaccttggggctgccgtagcagtggatgctcttcaggtcagtgtgggttagagggaataaccatgctgggagaagggttggagacatccattcttatgttaaaaagctctgccctaggtcaggtgctagagtaagtgtcccttgctagtatacaaagcagtgatacttataatattcttctgtacttacagttgaaggaggtttccaaatgatatctcataaatatttattggtgtttaattttctttacgctgtgttaaacacttgggattcagatattaatgtctccccaaaggaactcaagcccatgagagaaagaacagaaatatagctttttaagaaaatatgaaagttcccccacattggggtgctgtggcaacccatagagtgggagtttaggtgaagacattgctcctaatgacagggggaaccataagaggacttcttcagaacagactcattttcctccaatgtcccacagagagggatcctggggcatgaatggtgtaaggcaagggccagtctaaggaaagggatttgctgcatcctgggagaaatctcagcatccctgacaggatatttgggacaggaatgcaggtgagaggaggtttgcaatcgcttttattcaataattgatgaacactctcctgagaactccctcagtgctagaccctgagctgggaaccatgaacacagagattagcaagatatgatctcagctttgacagaactctcagtctagtgaccagcgattcctgagaagtatggtgatggtgggttcactggaaccagtggcccatgctgcatggagatgacctcagtggatggcctggtctctcttctgtttttttcatatagctgaatgacctatcctgggcccgtgaccctggacttcagccagatcagcatctcaaggtacaaccaacatcttggctccatgatgggtcaaaacagttaacacagccaaggtattcaaggtatcagtagctactgactatgtcctggccagctgtgaaaagaaaggggtgaatttaacaagtattctaaaattgtccttgacatagtaatcacagattatctatcttctgtctggtaatatatatatatatatgtttttgttgttgttgttgttgttttgtttttttgtgacggagtttcgctctttttacccaggctggagttcaatggcatgatctcggctcactgcaacctctgcctccgggttcaagcgattctcctgcctcagcctcctgagtagctgggattacaggtgtgcgccaccacacccggctaatttcctatatttttagtagagatgggttttcaccatgtcggccaggctggttttgaactcctgacttcaggtgatccacccacctcggcctcccaaagtgctgggattacaggcatgagccaccactcccagcctctgtctggtaatttaaatgctttggagactccaagattcacccatgtccaaaataaattctatatcagtcatagtactagcatttagaagttgtgtgttttatcctctaattatagatgaaatacctaaggtggaaaggagtaaagcagcttccatgaatgtagtgagaatgtaggggggttagggactaaagtcctgccttaggattccccagcagttgccagtcacaatttttgtactcttagaaacaacaacaacaacaaaaaaatgacaacctgttttgttcctctgcttaccctatccaattctctacaccataacatctctgcttatcaagacaacttggattctcaatttgttgagctcaacaaatgcatctcttgagcccctgtgggtaaagcattatgctagttatggcgggtgatacagaggaagcacagaagccacaggtgcattctggtgaaagggtcgatgataatgaatagtggttctgacagggctgggctcttaacctcccaaagatgctggtcaaacaggatctggaggatctctgcacatagtgtctgactactgactgtcataagtgaatgtcaccaagtcttggcctggatcccctccctttgtttcatttcacagattacatgttgacagcaggaaaatcaacagaaagaccatgaggctagactccaaaagacttagtaatgctgctgggtgggccatgaatttttaaaaacacatgaagggccttctcagaagtgaagttttaggaaatataaaatgcatagctgggatacattatagtgtactgatagaacaaatattggatatagcagcatctaataacttctggaggaaaaaatatttttcacattactccaattatggccttatatgacaaaaaagaaaaaaaaatccctaagagaaccactaacatccactggttttgtagaaacaggatacccttagtgcacttaaagttggaaaaatggctctgcctttagggccatgcaatgaaacagactgtgtggtagttgacacaggaagagcagagcagagtttataacaatggccacaagacagttaagaaaatgctttggggcttttaagcagcagataaggtgactcagaggaatgttagacaatcgcagaaaagcaacttcagcaaagtttttgattcagtaggcactgcatacttagtccatgctctgcatctgttctttcacagtctgtcccttcatcgacttgggcctacaatgacttttctgggaggggagagggatcaacacaacagcatgcacacacctgaaataaagaatgaatttctgattttcagattttagtctctgacataaccaaagaagtgactaccatagatgttaacttttttttattattattatactttaagttttagggtacatgtgcacaacgtgcaggtttgttacatatgtatacctgtgccatgttggtgtgctgcacccattaactcatcatttacattaggtatatttcctaatgctatccctcccccacccccccagatgttaactattaataacataaatgatgctcacaaatatgcagatcttataataacgaggtaaaatagcttaaaaaatagatggtagaactgtagtccagggacactaatagaagtgacccataacattacatcatctccacttccaacaaaaatcaggcaaaagaaggaaggagactggcaacccaatgcacagaactatatataacaggcatactagttattggttggttataaaccagtgggaataaatcttttttatatactgactcttggtttatgtcactgaggcacagcatggaacaatagaaaaccggactgtaagataaattcatttgagtaactggacttttgtaaaccattagacagacatttgagaaaccaaatttaaagctgttcgtgagccatgttagcctatcaaggttgaaattcaggagagatacataacgaaaaataaatgcttttttttttttgtgacactgtgatctgatgcattgggaatgtgatcttgtgaatcactcaggtgagcaagcctgacatgagtgggcataaaggtcagtaactgaagaggtaccaaaatgtgctacatgtgtcaattgtgacctaaagaactgaaggcattcaccctcccttgaagtcatgaagctgacacagcagggggctgcaaattccactgcagatcagggtcttgaagctgacatactgaagagtggactcccacttgagatacagagtaggaactactgtttcttacggctactgaatatcccacaaactaacctcctcagcatgccattattaattattttaaagctcttaaaggtctcattttataatagatcacatcagaaggaagactaataaggatcaggtacaaactcatacttgctggacatatcattgcatgtcatccccaagtttttggcactacataatgttggaatagattcttgaatattaaattttaaactaagggagaacattggcttctaaattttacaactatagtattgcagctaaacacaagtgcagatgagcagccttataactgcatgagtaatcttaaggaaaacttattggtgaacatacagaacatttcacatgcatttgtctacaaaggacaaactcttcccaacctcagaacttgatatgcgttaggacattcctctcccttgggctggtgataaagctccaattgaaatgagaaagattcttcatgcctggtaaatacgcaagtttccaaagatattgccactggccgatcaaacctgaatccaaaaagcatttgtttctagcaggatataagatcaatatgcaaaaataaattgtgtttatgcaattgcacggcagaatttaaatgtaaaaggaataccatttacaataatgtcaagtgtataaaatccataaatgtgaatatgactgaaaattagagcacatttcacggagaacatagtgcaggcctaataactggaaagatattgtttgctcatgtgtaagaatattgttgagatgttcatttctcctaatttgatctatgaattcaatgcaatccgactcaaaatttcagcatgcatcgttggtagaaaatggcagctgattctaaaattaacatgaactagcataaccaaaatgcctgtataacgaagtgcaaaattggagggctagctccacctgatttaaagaacaatcacagagttgtaatggccacaacagagctttggtatgtgatcaattaaatggatcaaaagataatagagtccaaatataaatgaacacatatattgagaacagatttttgacaatcttgaaaaagcaatgtatttaaaaatgcataatatttcaacaaacgattgaagattttctttttaagcaatggatgtgacatatttgtaaccatataaaaataaacaagtagaaaaaactgaattcatgtgtcatatcacatattaaaattagtggttacaagaggatgggaaggagataggggagaaggaagaaaagatattggttaatgcatataaaatatagttaaatagaaggaataagttctagtatttgatagtatattagggagactataactcaaaataacttcctgtatattttaaaataactagaagagaggaattgggatattcctaacataaagaaaagataaagttttgaggtgacagatatactacttacactgattcgatcattataaattgtgtatgtttatcaaaatatcatgtgtatccccaaaatgtgtgcaacaattatacatcaattaaaataatgaagagtacatcttagacaaattaacaatgattccaatcccatcgagtatcttttctgaccacaatggtatgaaactaaaaattaactacataaggaaaactggaaaattaaaaaatacatggaaattaaacaacttgcctttgaacaactgattgatcaaagaacaaatcaaaagggaaatttgaaaatatattgaggccaacaaaagtgaaaacaaacataacaaaatctttggaaacagcaaaaacagctcttaagagtcaagtttataaccataaatgcatacattaaaaaattagaaagacttcaaataaacattacacctcaagaaaccaggaaaaaaacaacaaaataaatccaaagttcactgaaaaaaggaaacaaaaatcaatgcagaagtaaatcaacttaagaacagaaatactacagaaaaataataaaagtgagttgttggttttttgttttgttttgttttgtttttttccttttcctttctctttctttttctctttttaggagagacaacgtcttactattctttccaggctgattgggaactactggcctccagtggtgatgcaacgtaggcctctcgcacccgagttgtttttctggaaaaagtaaaattaacaaacacttggctaaactaactaagaaaaaaatagagaagactcaaataaataacatccgaaatgaaagtggaggcattacaacagaagcctcacaagtaaaaaggatcataagaaactattattaggccgggcgcggtggctcctacgcctgcaatcccagcactttgggaggccaaggcgggcggatcacgaggtcacgagatcgagaccatcctggctaacacggtgaaaccccgtctctactaaaaatacaaaaaaattagccgggcgtggtggcgggtgcctgctacccagctagctacccagtagcgtgtagtcccagctactcgagaggctgaggcaggagaatgacatgaacccgggaggcggagcttgcagtgagccgagatcgtgccactgcactccagcctgggcgacagagcgagactccgtctcaaaaaaaaaaaaaaaaaaagaaaaaagaaactgttattaacagctctataccaacaaattggataacctagagtaaatggataaattcttagaaacacacaacctaccaggattgaatcaagaagaaaccgaaagcctgaacgaccaacaacaaataaaaggactgaagaacctcccaacaaagagaagcccaggaccaaatggcctcacagctcaactcttccaaacattcaaaaaagaaccgggcgcggtggctcacgcttgtaatcccagcacttcgggagtccaaggtgggcagattacctgaggtcaggagttggagaccaccctgatcaacatagtaaaaccctgtctctactaaaaaaatacaaaaattaaccgggggtggcggtgcctccgtgtaatcccagctacttgggaggctgaggcaggagaatcgcgttgcagtgagccgagatggcgccactgcactccagcctgggagacggagcgagagtctgtctcggggaaaaaaaaaaaaaaagaaagaaaaaaaagaaaacgaaaaccactgcaaatcataatgcattttgtccactttctgagaatgtgatttcctcttcctgtggaaacagcaataatttttatgagggggtgctgcccggaccccactggaggagtgggtaagatgaggattgtgctcggtgttgcctccctacagaaccacacatactgatctgtaatacctgtggcccctaagtgtccgtgaagggactggtccctttacaacattgcgtatggctgcggaaacccactatgtggcaacaagatgtatatgtgtgggttggtggtaaaaccattataggcaacggaaattcaaaatgttccagaactcttaaaagttcgcctcatgtagtatttggtttcttgcagggggacccaagcccccggggctgtggtcagctacctgtcctgggcctgttaggcaccaggccgcacagcaggatatgagtggcccgcaagcgagcattccagcctgagccccgcctcctgtcagatcagcggtggcattagattctcatagaagcacaaaccctattgtgaactgtgcatgaacgggatctaggttgcgcgctccctacgagaatctaattaatgcctgatgatctgaggtggaacagtttcattccgaaatgatccttccctcttttcacgtcccccacccctggtccaaggaaaaattgtcttccacgaaaccagtccccgaggcaaaaaagtttggagactgctggtctacagtgtcccaaaacccttttctatggttccttcccaaagcctggaggctctaagtcctcccctgttcttatactcctgtgtgtggagaaaaatagcatttcctatgctctgaagtttctccagaacattctttctaggcaacaggatggagattaataataacagaatatttggcatggccttgttagccaatccaaagccctctgggctgaagtgggggtttttcacttcagggtcatccagcctgggtaccttccatctcagcatccccaggcacagacaggaaggtgacatcaccccatttacatgatgtctgtctttgtggcctgggccactgggtggcttacctcagaggcggagatgtcagagatgggtgttctgggcatgattaacaaagggaaaactgagagcgttcctactgaagccccttctcctttcagctcccacccaggtggcctgtcctcacgggccttggagtggagacttgagccaccacctgtcagaggtggagacttcacaggcacagctggagccaagaaccctggtgcccaattgtctgtgactgcaactggatcaagggtttgactgtggctatggcttagccaggcaggatgtttcctccaccacctgcagcttcacaaccaacggtgatcctgggaaccaatggcccttccaaggtagggaaggaaaggggaccaggaagctctcatccgggtgtcctggtcatggtgctgtgaggggaggaggcaatggggtctcttcgtgctccctcagagtcaagcagaaatccacaatgttccaacccagtgaggtgagcaagagcctggggtttaggatcaaatctgctctcaggtcctgggcttaacccttactcattattcatctcggccaagttatttgtggtgttggcatttacatctcagtcctgtcatctgagagacctgaaaaataatatctacattccatcattgttgataacattaattatgataatttccaaagggctaattcagtaaaaattgcttaataaatctatgaatagatgttatctaattctgttatctttctggtaagttagcactcaggaaatgacttcacgtgcattgtttcaactgaggaagagtaactgttaggatctctactttctagagactcccttcctgtgtttacttagaaagtatcttttgccagttttctttctcttcctcagcatccctttttaagtcaatttccccctgtcatgcacttcagtaacaacctattaggcacattagtaaaagtgcaaatcctgggcccacaagtcagtctcctgacatacccagcttcttgctctgttttctcccctcgttttgaaataaaagaatgaaagggcaaccttctcatggaaagggtataaatctgtctcttttatgaaactccatttagttcatcatctccattcatgcccatggccatgtcctcagttttcttctcacagggatccacttctgcccagatttccttaaaaccctgggttgtgttcatccttactctccgtcccactcaatatctactcctggagcccctggggctgcctggtgctcatctgtcaatcgatgcccgcagccgaggaataaggagacccacgtcctcaggaggagggagggtcacgtgagataacgagcaccatctgggtccatggagaggacacatggaaaacgctcagtgagtgtcgggggatgcgtagtccctgacacgtgccctgataactttgagtatttaaactgatttcttcccactggtgtctcttttgcttctccatggattcctgcacccctagtcaggactcaccccgctggctccaacactcttacctgctggctttcccaggagtccggatcactaaccaggttccaggcaagaggacagagtgaatgccttttgtttcattgtcctttacctggtgacttctccttgctgtctaatagggcatttgtttctcaccatgtcttctctctctcgttcatcttatttttctaaaattttttccagtttcagtggaccagattataatgttagtgattataacgctaattcaacatcttccacatccttatgtaataatttcttccaatagatttatatatataaatatatgcatttatgtcattggatatatatattatgcatatttggcatgtatttttaataaaatgtagatatatgctatatacatatctgcatgctcatttcatcaatatctcatgtttagtctatccaattcttttctctcatatgttcatttaatgttgagttttagaatctcctccctcccaaaacacagcctgtatccagtctgacttccttgcctttgccttatctacctggaaactatttgtgtttattaatcctaaattttttgaatatgtttgtcagttgggatcaccttttcctcctggcaatcttgtcattactgggtgatgcatgaaaaatcaacaatacagaaaataccaaaatgtctttcctggcttccctttacccgttggactttcttattcaaggccgctttccttctctgatgatcctcttgggtggaagagaaagtcacagtaagatcatggatgacagtgaacactgttgggtgtggtttcattttcagagctgggtttagagccttcccttgaatgaagaaccctccccagctggaaggtgatgctattgaaggctcagctgacaacatacatgggcatcaagtcattggccacattcatgcctcaagtgtcctaaaaccgaagatgatcaaaagaaaactgctgttcagcaagtggagactggcatgcagattccctggcctgcaagcttagagcaggaaggtaatcacatctatggctcttagctgcactcactccttattcctctctgtctatgatgacagctccttctcccactgcttttttcttctgtatttgttctctccagcagctgctgtcacctctgtctggtattacctctgtgtcccatgggctgccatgctgccaggtccttctgatccccatcccctgtttgctctctgaactctgctctgttcccactgctgttgtcctaagagtccctctcatggccgcaggagagcccaacttccttgtccccctccaagtgcatggtgtgagctgctaaacacagggttctttgcctggaattgcacagattgagtaatttgcctttcctttctgcatcccaaactccattgcccctttccgccaggagcattgctttaatacatcatttacacaaagatttttctcttgggacagcttttgagcaacacaactaagtcaaactgtaaccctcaccttgtacatgggaatgagaagtgttaaaactgagcactaagaactccaaatcaaaaactaaattagaacctgggtcacagacgagagttcctactagcctggagtcaggtgtgtcttcatctctagatgggcaaccttatgccagcgtggatgaagtttccagggactgtgtctgctcctcatggactcacttagctgacattaactggagaacatttatgacattccaaagggacctcagccaaagatagatgcagagggcagggcaggactttgaacctacatagaccacaaagtgcattctcacctctgtcctttttattcacatatttacttctacaagctcagttagagtctaaaacacaactcaggtgaatcttgaggacagagaaataagagagcatttaatgaattaactttgagaaaagtgagtccaggggccagctttatgtctacacaagatgatagacaagaacctatctacaggacagactttgcctcagaccagcccaagtgagagatttaattgaaatagtcagaagaaagactaaaatccacagagccacagagaatgaaggcaatcacgagagaaatgaggataggaaagaaaatgatgggaaatcaggttggttcattcattgtctctaaatcctgctaccatgtaataagcacctggtgagatttcaataaagatgaatgccttgaactgacatcttgagattctcacttaaatggtctggggtgtgatgtgagcatcagtacctttaaaaaacttccatgatattctaatatacaactgaagatgacaaggaccactggtctactctgacctcaggttttcaacatggagatgaccacttgtgtggctactccacacaaaaggtggaatatccatcagacattgatgggatctgtattcacctctcaacagtagtatttgtagaacgtagaaaaaaattaaaaagaaaaacaagaaaatagatggattagacctgtagtctctctacttaaagcacacttgcttaattttgagtacaagtaaaataagaaatagtcattatattgaaacccagtatacagaaaacaatacctcgtatattacacatattcagatttagtattttcttttaaattttattttattgtattttatttttaagacagagtctcgctctgtcacccaggctggaatgcagtggtgcagtctcggctcactgcaacctctgtcttgcggcttcaacaattctcatgcctcagccttctgggtagctgggattacaggtgcctgccaccacacttggctaatttttgtattttttagtagaggcatggtttcaccatgttggcaaggctggtctcgaacttctggcctcaagtgatccatccacctctgcctcccaaagagctgggatttaggcatgagccatcatgcccagccttcttttcaattttaaaataaatcctgcagtttacatttccacacactgattccacagcccattaatgggttcggcactgcaatgtaaaaattctgctttgctcaattcttgtcattcagccaaatcctcaaagagaactcgtaggtctcactccactagacagaatataataataagtaaaaactgaaacttggccgggcatggtggctcatgcttctaattccaacactttgggaggctgaggagggtggatcacctgaggtcaggagttcgagaccagcctgaccaacatggcaaaaccctgtctctactaaaaatacaaaaattagccacgcatgatggcacgtgcctataatcccagctactcgggaggctgaggcaggagaatcacttgaacccggaaggcggaggttgcagtgagctgagatcacaccactacactccagcctgggtgacagagtgagactccatctcaaaaaaaaaaagaaaagaaaagaaataataataataaaaaaactgaaactcaggaagagatgatatatgaatacttttttatgctacccttgatgctggcatgaaattctaaaaagaaatctttcccaacaaaccactctgggaaaaatgtaacagggagaggagaatgtaataaaacacaaactaatccttttcactttctacttcagagttttgttgatcagatattgagcatgtttctagaaatgccttaaggtgtaaccaggtgtggaatcaacttcagggaattagggataataagtcgggccatggttgcaatcaccacccttcctttgtaattccatttgactctttccttttcttctgatcctttttggaagaacacataatatttcttttgtctttttctcattttttattttaaccaacaaaacaagcagcagtgacatcatatttctttgtaaaagctcattcctatcctagccaaggtgacccagcaacctctagtgactgttgagaactccagattggagaattgactctcccttctctctaacttattgaaagagactttgtgcgtgggttctagtttcagggttgtccattgcaagtcatgtggctttagttaagtcagccttgtggcatcactgctcctctgttgtaaaaggcagaactggatgtggatgcggtctgaggtccttcctgtatctcacctccagggttcttcccatggccctgcgcacccttccctaagagacggggacatggagttgtaagggagtgggtttctctgcaaaaggtcctttccttctgcagccttctgtttctgagctttcatggttgatgctgagaacatcctcactgaggggtgtgaaaagccattactctgctccagacactggggatcaggaggaaaggggctgctcgttgggcagagctaggatccctatatccttcacctcaagctgactggaagttcaggggtgtttatttttcacttgcggatggcacttgcctcttcactcagcctgaggctcacccttcagctcatcctcctagcaggagctcagtttgcccctgggctatcaccacttaacagtccctctagactcagccatcagcaggacctgacaaagatgcccatttgatctttccttctctctctcctacagatactaaatgctgctggaacaatgaaaagaaagaacggatgtcacaaaaagcattttcatttgatgaatagaactaaaagagcaaagcaattgaaagctcaatacaacacaggagggatccatggctgaggattgtatttcagaaccactgactgctcttgacaattgttaacccactaggctcctttggttagagaagccacagtccttcagcctccacttgataccaatacttaggaagaccaaagccagatggacaaacagcattgagaggctttagccctactcctctcagcttccatcctgtagagaacaggagtcaggagctgctggcaggagacagcatgtcacttgggactctgccagtgcagaatacgaacaatgccatgttcttgctaaaaatgcttagcttgagtttcataggaggtaatcaccagatagacaactgcagaatgtagaatactgagcaggacaataacctgtctccttcagacagtccatgtcaccacgaatcacacaataaaaaggagaaaagacattttgggttcaaaaaaactaaaaagataatgtagctatatttctttagttattttgaacccaaagtatctcctcatctttttgttgttgtcattgatggtagggacatggacttgtttgtagaggacaggtcagctgtctggctcaatgtcctacaagagacaggggggacatggaagtgtacagctatatttgtggattagtctagctatctgttcagtatttaaggttgttgttgcatagatatttatgacttgaaattttgcatagatatttatgacttttgtcaggggaggggttggtggattggtcctttcatcattttataacgtccctttctctctctgattagtttctttgttcttttttctatggacatctttcttttaaggcagaactgctggtcagagattcccttagcttttcttaatctgaaactgttttgatctaccccttaattcctgaaagactcagcaaataaatacaagacataaataagaaccaaatggaagtattagaagtgaaaaatgcaactaaaataaaaagtccagcagataggctcagcagcagaacggatggtgtggagcaaacaaatccatatactgcagatgagaaaaacagaaattacagaatcctaacagggagatggggttttgccatgttgactaggctggtctcgaactgttgacctcaggtgatccacccaccttggcctcccaaagttctgggattacaggcatgagccaaagagcctggcctcccttctttatttctatcatgaatagatgttgaatttgtcaaatgatttttcttcattgactgataaacatttttgtggtctggttttggagttggggtaatcatagctttacagaaatagtcgagaggtgttccttcatcttctattttctggaacagattgtacagaattgatgttaattcggctgggcgcggtggctcacgcctgtaatcccagcactttgggaggtcaaggcgggcggatcacgaagtcaggggatcgagaccatcctgactaacacggtgaaaacccgtctctaccaaaaatacaaaaaatcagccgggcgtggtggtgggcacctgtagtcccagttactcgggaggctgaggcaggggaatggcgtgaacccggagggcggagcttgcagtgagccaaggttgcaccactgcactccagcctgggagacagagcaagactccgcctcaaaaaaaaaaaaaaaaaaagaattgatgttaatttttcttcaaccgtttggtagaattctccagtgaaaccatctggacctggagcttttctttctggaaattttaaaattaggaatccaattattttcatagttacagagctactcagatgacctgttttgctttaggtaagttgtggtagttgatacttatgacaaatttgtccaattcatctgggttgtcaaatatatgtgtgtacagaattttaaatagtttttcccttattattatccctttgatatctgcagtctgtaacgagtgtagtccctgtttcatcctgatgttcataagctgacttctttttttctttgtcaagtttattgatcttttcaaagagacagctttattttcactagtttccccttttgtttttttctgttttcaatgccattgatttctgctattatctgtattatttccttccatttgctttaggtttttttttttttttttgtagattcagtctcattcccatggcgcaggccggagtgcagtggtgcgatctcagctcactgcaacctccacctcccgggttcaagcgattctccttcctcagcctccagaatagctgggattacaggtgggtgctaccatgcccagctaatttttttgtatttttagtagagacggggttttgccttgttggccaggctcgtttcaaactcctcacctcaggtgatccacccaccttggcctcccaaagtgctcgtattactggcgtgagccaccgtgcctggcctgctttaggtttcttttacttgcttttttcttgtttcttgaggggggagcttaagtgtattcatttgagacatcccctcttttcttttatcccttttaaaaacttttgtatataattattattgtaggaagttaggcttgggcccgcaaactatggaagaacagaatatactaggccgctgctttaatagctggtgcctgcttgtcgcccacccccactcccccaccttagctgccttgtccaaaccaaagagtttagtctagaatggacatttactagcctgcaaaatagttcactacatctattcttatcagcttgcctgactgcccaggtcataagtcaaatacttgaaaagcccccgagctgaccatgattgcaatgcattatgggctgcaacaaaatacagggagacaaccctaaaaaaaaaaaacaacaacctaaaagtcccaacccaagatccaataggcgacatccgggaatactgtgaccccatagtactcagcctatgaggaaccgggggaggcacttccacactaggggataaattgcttgttgtaagcctactgggtgtgcctgcctaccagacacccgatcttgcaagactgtcattaataataagtcgcacttctgctgttttccgggtcttggagtccattctttgggtttggacgggtgagtttatttctcacgattatttccaggcaggccttgcccagtgggtggctcatgcttgtaatcccagcactttgagagggtaagcctggtggatcacctgaggtcacgagttcgagaccagcctggctaacatggtgaagccccgtctctactaaaaatacaaaaattagccgagcgtggtggcgagggcctgtggtcccagctactcgggaggctgagacaggagaatcacttgaacccaagaggcggaggttgcagtgagccgagattgcatcactgcatgcgacagtgcaagactccgtttcaaataataataataataataataacaataataataatggcacgacctaaagttatgcaagcatttgccttagataaaatttcaagttttcaaagttgttagctgggtggaccacatggctttacttcctatttcttggtatttcctaatcttgttgaaaaagtttttctttttctcaaaggcttatttcagtggaagcccatctgcaaaatctgttattaatttaaattagaaaatcattacaagtcccactgacatgtgggttattgtttttgcgagtgacctaaggccacttctcgggggagctgggggttgccttcccacgtctgcgcgtctgcaccccatgcccgggcctggaagtcagactcgggggcggtgctgcagcaccaggcctgcagtcctaagcgcggggtcgctccgggcccccgagggggtgtgtcttctgcccctttaacctggcaggggcggttcaagtggccctggaaatcagcgatttgtagggtcaagggctggtgctttaaaagagaggcggaggggagagagggatttcccggtctctgctgcactctgtctatccgctcggttactccttttcctggcccgcgcgaacccgctgtgctgcagaggcggccatgtacctttaaggccccgctgcgcctgcgccttgggctctcctgacgcgctgagcgggaccctgaggagccagctggcgcaggctatgggctgggcggcggttgagacagcggcggtattgggaggggtaggtgagggtcgcgaggctgcgtgagcatctgagtgaacgcggtgcttttgggaacgcgggacgggcgacctgtggcgccaggagcgggccgaggcgcggcgcacggatgccgtctggatgggaagttacggtttacagcgaagtccacccagcgtttccgaggtgaaggcgccgcgccaggccggggggcggtgagtccgggacccgcgggtacacagctgggtcgagctgcggctgtcgcaagttttgttgcgagcgacggagggcgaggcggggtggggggttgggagggcatgtgttccggccccgccgaggcttaagttccatgcgttcgattcctcgcttgccgctgccgcccgcagccctcatctcttgggcgctggggaagaaactcgctggcgggtgttctgtggcatcccagggggtggagggacgagcagcttcgggggcacgtcctcgtgtatcctgtggaggaccctgaccccgcaccccaccctcgaggccagaaatcagttgcctctggggacctgagaggcgagaccactcgcgcccctgacttgcaaagttggggtctttattggcctccgggattctgctcctggcggtttctccaggctggtgatgggcaacacatgaggcgcgtttgtagccatcactgaatcacctcatgactagcggggcaggcctctaattcaccgcaggatttccagtaggttggattgtggggttggtgtttgcactccaaagagttggcgtgatttccctgtatctgtctttctggcttgttagatcttctcatttggcgtcctttctccgaagagttaaccaagacgtttggcgtggttttcttgctttcctcctatcttttgctgctagagctgctttcaaaaagaagtcttttcttgcagtgataccttttctttgggttacagtgttgttcatcctttctttgccgaaagaatgaatcccagtgcttcacgaagttaaaggaaagatctgctggtagtgtttagtctttgttctgagctgatatgtgttagtagctttttgtttttaaattttattagtaaaatttcaccagtgaaccagaagctctttttttctgttgtgaaatgctagctttaagatttctgagaactttgtgtcaaagaaatctttgaaaagttactgaagtatacagagaggttcacaattttaaatgtgcaggtggtccgggcgcggtagatcacacctgtaatcccagcactttgggacgccaaggtgggcggatcacttgagcccaggatttccagaccagcctgggcaacgtgccaaaaccctatctctactaaaattacaaaagttagctgtgtgtggtggtgtgtgcctgtagtcccagctacctggtaggctgaggtgggaggatcaccagagcccaggaggttgagattgcagtgagccgtgatcatggcagtgcactcccgcctgggtggcagagtgagaccctgtctccaaaaaaaaaaaaaaaaaaaaaaaagtacagataatgaatttttaccaagtgaaccaccacagatcaagaaatagaacattactagactggggtatatttgtaggagtgacattgttggttttagaggtatatgaatgataaaacttagtattacatattgttgaacgttttcccaaagtggttgtaccatttagcagggatattctggttaccccacaaccttgctgatgcctgtcagttaaaaattattttgccattctagtaggggtgcagtaatgtatcagtgtgatttcattttgcattttcctggtattgagattgagtatcttttattgtcatttgtgtgtcctcttttgtgaagtgcctgttaaatctttttatccagttttcattgatatgcttgtttttctgttgatttgtaatacttttttccggatatgtgtcctttctacgatatatatgtattgcatttcccttttttcaatctgtagcttgccttttcgctcttttaatggtgcttattcatgaatggagattctctaacttttttttttctttttgagacaagatctcactctgttgcccaggctggagtgcagtggcacaatcacagctgaccgcaaccttgacctcccaaggctcaggtgatcctcctgcctcagcccccaggtagctgagacctacaggtgagcaccaccacactcagctcttttctatatttttagtagagatggggttttgccacattgcataggctggtctggaattcctaggctcaggtgagacatctgcctcggcctcccaaagtgttgggattacaggcatgagccactgcacccagcctgagattcttaattttaatgaaattatactttatcaatcttttcctttatggttactgctttttgtgtcctgtttaagaaatcaatgcctaacctaggagtatgaacacatttttctgtgttaaccttataacaattttattttagtttttgcatttctttttttttttttcagacagggcctcactctattgcccaggctagagtgccgtggcaggatctcagctcactgcaacctccacctcctggctcaagcgatcctcccacctcagcctcctgagtagctgcgactataggagtgtgccaccatgcctggcttaattttcatattttttgtagagatggggattcaacatgtttcccaggttggtctcaaactcttgggctcaagtaatcttcccacttaagcctcccagagtgtggggattacaggcatgagccaccccacccggctgtgattcactttttactacatggatgtgtctgcttgatccagcaccatttattgaaaagactatccttttccttctgcactgtttggcactttttttcttaaatcggatgactgcatggtcatccaatttatgaaattagtgtgggtctgtttctgtttctggaccaacctgggcaatatagtgagatcccatctctacaaaaaataaaaataataaataaatgagtaaaatttaaaaaataagtgcatagagcagatggagtcataggtgataatttataaatgattgtcagtttcttggctacatacgggtgttggtaattcagatgtgttgggcattcagggaaaatgtattaagggaagtatgtggtgttcacagtgattgctagatgttcattgtgacttgaattagatgttatttgagcctcacagagctacagttttgactctttatttatttatctttttacaatttttacaatcttcctgtcaaggcagtaactcttttatacttcattgttcttaggtatacttaattaccaggaaaactttatggatcgtacctaaataagcgttaagccatttaaagggccgacgtgatatgatgtaaacaatagtattctacataatagttttaggactacatcgaacaattttttttttttcttgagacagtgtctcgctctgttgcccaggctggagaggagtggtatgatcatgggtctctgcagccttgacctctcaggctcaagcagtctgcccacctcagcttccttagtagctgggtctacaggcatgcaccactatgcccggctaattttctattttttgtagacagggttttcctgtagtgcccagactggtttcaaactcctgggctcaaatgaccctcccaccttggcatctcaaagtgttgggattacaggcataagccatcaccgctggccattttagttttaataatttttatgtttttctaatttaaaagatttactaaaatctcttacagctattatttatgaatatagtattcattgttgttattatgattattttgtatgtgttcaatctcattttcaacataagctcctggaaatttgagattttgtctcttattcaccactgtattctcagtacttgaccttgcctggcatgaaacagatattgaataaatatttgttaaatgaatgaatgaatgaacatactaataccatattcaacaatctccaagtgtcacagttttcaccatctaacaaataaaatagcttgtatacagcagagtcacagtcaacctgacataaaaggaaatgtcaatgaaaagtaaacctttgtatgagttgctgctaagattttggggcttttgttactgtagcataacctagcgaaagctcagcgagacagcctgtagaatatacgtgtacagatagaccagatagaccagtagatgagattccaaagaagcattaactacacccacacactcttaattccctaacagaaagaatcgaattcttgttcactaagatctgcctcaagtattacttggtgaaaacttccctggctactcaagtatttagtcaggactctttatttttttttcccccaggctggagttcggtggtgccatcatagctcactaacctctaattcgaggctcaaggaatcctcctgcctcaaccttcagagtagctgagactacaagtgtgtgccaccatgctgggccaatttttcattttttattttcagagatggggtcttactatgttgccgaggctggtgaggactgttgattacatatgacaggaacccaaacaattctagttccccaccacctttcaacctgctcctccctgggtcttcccagtctccgtaaacggcagctccatccttcaagttgccgaagccccaaatctcaatattaaccatgatttctctcttttatctcataggcaatctgaaagcaaatcctgtttagatgcaggcgaaggttcctggtgacccaggctctcaccttaccgtcccttaccgtcctcctgagggtgtcctggagcttcagtgctgtgtgttcttggcctccacgctgggggtgccaccaactcccactgtccagggcttccagtggactctccgaggtactgatgtagaaacttccccattcggtgcaccaagagcaacctcacacggtgtgggccgaatgaagagctgccagatcccacaggtaaaaaccctgaggcattgccagctcgatggagtcagagagtcctttttctattatgactcagatgtgaagggaagatgccaagggccctaaacatcgcagggccttgcctggcatgaaacagatactgaattaatatttgttaaatgaatgaacaaatattcacagcatgtgccaccctcgacctgcagtgctgttgtcaggtggaagtgattttacttcaggagaggacagtgttctctccaggacttttccttagtagctagatctgcatcccactccttgctcttcccctcttaccccccattctctgcccccatttccgtctcttgtttccaccctgccgtcccctttcacctgctttcttctcttcagctttcatggctcaccccctccctgtccacccgcatcccccaggctaaggccctgcactgtcctgggtggggagatgtgtgtggttttaggcagtgccctctagatgtgtccaggatggggaaacatggctcagttgccagtataatgggttaaaagagaggccacttttgaaggccgttcccatctcccattccagaatcctgtaggacttagaatttatgggccacagtggaattcttggttccccaggaccttgtggtggatgccttctttcactgagcattcatggggtgactattaggcaccatgccctgctctgggctagagaccccataacgagtaaatctcaggtcactaccccatggaacccaccactgcaggcattgagagggggagaaagaaaggggcatggcctgtttgtatccttctcacgtggccgtccaccaggtcctgggggagtgggagccagtgcaaggagggaagtccagtgagaatgacaaatggacgatgtcagacccaggggctgaggcccccacctgcagctgggcagcttctggagtggacaaggagcagcagggaaggttgcggcctggtgttctgggatccactgtctcatctcattcttttgggcaccagaacttatccaaagacaagactcagtgtctctggcaacagtgggccagaggaataatgtgtttcagagaaggaagaaggggttgtaccccatggaaacagtatatagttttacagtagtgcgtctgtctccaataactagttagcgtgttcctgttaatggaaaatactggtggtgtaagttcccctggatgttctcatcttcatgtaagtttgttcatttccttccttccttccttccctacttctctcccctccctacttctctcccactctttttctctctctctttattctttccctccctccttcccttctgccttccctcccttcctttcttcctcccttcctccctccctccctgccttcctccctccctcccttccttccttccttcctcccttcctccttccttccctccctccattctttcctttcttcctttcttcttttctttttctttgtctctcatgctctctctttttctttcctttttgttctacttttttaaatagaccacactgcactgaaatctacattacttaccaaaacctctggagctgcttctgtcttgtaggcagggagctcgtcctgtagcccttaggtcctcccagcctcctcctcctctgatttgtgggtgccactggggcagctgctgagtctcagtggttcctagtcatcaccaagttctgcccacctagatggtttgcacctgtccttaccagaaccctgcactgtctagatgactgaggctgcttctgcctaactgatctgctatctgtgttctgggggcaccccagggttagaggtaaatggcacaggcattgaaatctccaactgctctgactccaggttggtgcacttcaatgccaagtactaaccacacaataacaggatgccaccaaaaccttggtatggggctgctgcatcctaattaaaaaaaagtaatagatgttattttttagaaaagttctaggtttacagaaaaatggagtggatagtacagagagttctcctaggctcccctgtcctccagcacacagtttcccctattagtatgttgtattagtgtggtccattcattacaattgatgaaccactattgatacatcattatcaactaaagtccatagtttacactagagttcattctttgagtttcacagattatgggttttggcaattatgtaatgtcctaaatccccaatacagcatcatgcaaaatagtttcactgctgaaaattccctgtacttcaccatttcgtgcctcctcctctcctccacccctgacaaccactcatcattttactacttctatctttttgactttccaagaatgtcctagagttggaaatacagtatgtaggtttccagactggcttctttctagcattatgtacttttaagttcctccacgtcttttcatgacttgacagcttgttttgtaaaatcactgaatcagatttcattgtatggctacaacacagtttgtttattcattcacttggtgaaagatgtcttgggtacttccaagttttgacaattatgataaaattgctgcaagtacttatgtgcaggattttgaatgaacttaagttttccaaagtgactgtacacttttgatttccactagctatggagagttctggttgttcctcatcttcgacagcatttggtgtgttcaccgttttgtgttttagccattctgataggtttacagtgatatctcgttgttttaatgtgcaattccctcacaacaaatgattttgagcatctttctcatatgcttatttgccatctgtatatcttattaatgaggtgttcagatctttcaccttttttttttttttttgctttgtgttgtttagttctcagaattcttcatatattttggacagcagtttttccatcagattattttgtaaatattttctcccagtctgtgacttgctttttccattctcttaacagtgtctttcacacaacagaagtttttaattttaatgaggctcaacttaattttttttcattagtagattgtgcttttggttttgtatctaagaagccatcattgaacccaggatccctcagattttctcctattttatctcttaggattcttatggttttgcaccttacatttacatgtaagatttattttataaagggtatataacatgcatacctggatttatttatttttttgcatgtggttgtccagctgttctagcaccactagttggaaaggctatctttgctgttttaaattgtctctaaacctccatggaagatcagtggactgtatgtaggcctgcttctgggctccgtattcttttccatgcatctatatgtgtgtgttttctcttttcaccaacttcacactatttgggttactgtagcttaatgtaagtcctgaagttggtagtgccaaacctcagggagtttttctgaacttcatcatgagaacctggttgagatcattgtagtaacacttggaaatgtgtgagattcccccttagtctggtcttcaaggagtttttaatgttctagccaggctaccctcagcttctagtaatctgtcaataccatttaagtgctcctcccacttgctgtccccagtagcttctcttccctgtgagctgtgactccttgtgtgttagcctgtgtttctcatttttaaggtggcagttttccctgtgacctcaattctctgatccaccctagaaggattgactttcagtttgttcagcttttttctagctgtgaggacaagtgatgactgcctagctctttccatgttgaaatagaaacccaaaagtttgtttaaagaattacttgttataaaagtcccccattgttaatgtacaacccaatgatgtaagttgatttatcgaattgtgcagccatcagcagagttctacttcagcatattttgtcacttcccaaattcccttgaacctgtttgtagtcatttcctaatccctggtccccatgactgggtctgaataaaataaacatttggaaagcagatttcattatatttacattttcctgtgtttgggactttatatagtggactattgtgttcattttgtgacaagtagagaagagattgcattctagggatggtttttggggaaacataatagtagtcctgtttatggctctccttgaattggttcatctgtgctggtgactggtatttgttaccaaaccttgtctggtgagcacaagaaaaggaattttttaaaatctgctattaaaattgagatgatacattttcacataataatatttggagttaagtagtgaaccgtctttattttatctttttttttggagatggagttatttctcttttccttgggctcaaatgcaacggcaccatctcagctcactgcaacctccacctcctgagttcaagtgattctcctgcctcagcatcctgaatagctgggattacaggcgcctgccaccacacctggctaatgtttgtatttttggtagagacagggtttcttcatgttggccaggttggtctctaactcttgacctcaagtgatccacctgccttggcctctcaaagtgctaggattacagacacgagccacggcctgacctgaactgtggggaaaagaaagagagatcagattgttactgtgtctgtgtaggaagaagtagacataagagactccattttgttcggtactaagaaaaattcttttgccttgagacgctgttaatctgtaaccctacccccaaccctgtgctccctaagacatgggctgtgtcaactcagggttaaatggattaagggctgttcagggtgtgctttgttaaacaaatgcttgaaggcagcatgcttgttaagagtcatcaccactccctaatctcaagtacccagaggcacactacactgcggaagactgcagggtcctctgcctaggaaagccaggtattgtccaaggtttctccccatgtgatagtctgaaatacagcctcgtgggaagggaaagacctgactgtcccccagccagacacccgtaaagggtctgtgctgaggaggattagtaaaagaggaaggaaggcctctttgcagttgagataagaggaaggcatctgtctcctgctcgtccctgggcaatggaatgtctcggtgtaaagcccgattgtatattccatttactgagataggagaaaaccgccttaggactggaggtgggacatgctggcagcaatactgctctttaaggcattgagatgtttctgtatatgcacatcaaaagcacagcacttttttctttaccttgtttatgatgcagagacatttgttaacgtgtttacctgctgatcttctctccactattatcctattgtcctgccacatccccctctctggaaatgcccgataatgatcaataaatactaagggaactcagaggccagtgccagcatgggtcctccgtatgctgaacgccggtcccctgggcccatttttctttctctgtactttgtctctgtgtctctttcttttccaagtctctccttccacctaatgagaaacgcccacaggtgtggaggggcaacccatcccttcactgaaccatttttattcttccagaaatgtgattgataacagtaaagccacactcctcaagtgcctgaaatacccctcattgtcttcttcaggtggcaagggctctggaacagccacataaaggtgagggcaatatttttactgtagttctttcattgattggttgattgatttttttctcttagagggttagcatacatttatctgaaattgaaattcaagaggagagacaggcacctgtactagttttctcttgctgcctattatcacattaccacaaaccagtggtttgaaaccacagaagtctggaatgaagtggccgggttctctgatcagagtcatgtgaggctaaaatccgggaatgggctggctgtgtttttttcctagagctcaagctatttttccaggttcactacagataatgaaagagttcctattcttgtttgtgggggactgagggccctttttctgtgctggctgtcagcggggagacagtctactctgactccagaggccacgtgctttcctccttacctgtctgtttcatctttcaaccaataacaactcatggagtccttctcaagctcccaccttctctgacttcatcttctccaaccagccacacaaagctctgtcatgtatggagtgatgtgattagatcgagttcatgcggtaacctcaccatcttaaagtcatataactggcatataacaacatagtcacaggaatggtgtctcatcaccttaagaggctttagagacaagggtgtggcatgtttggggaccatttcagaaattccatctaccacagtaggacactcacattcccccatctgcaaagtgcatttaccctctcccctgaggtttccagatttcatgtcattaaagcattagttcaacatgaaaaatgtcatgtagaccacatcagatcaaaagtttaaaatcccatctaaaacatccacaccaggtgtgaatgaggcttccgagagtgtccattaagtgcagatccttgacataattcccttacctctgtcgacctgtgaaactgaacaaacagcttatctgcctctaatgtgaaatgatgggacagacatagaataacaactacagtgattctagttcaaaatgagggaacatggaggggataaagaagtcactaacccaaaatagtttggaaatggagctgggcaaaatccagcaggagtttcttagttaggatccacagcctgggactgaccctctgtcctgtgggtctttgcctctgggctctctgctctgcatttcttgaaaccattattatttatcatttttctcacactgttttgcgtatggctcctattgcactcaaaatgtttttgagattcatccatgttgttttgtgtgtcaaaagtttgttcctttagccattccatggaatgaatgtatcacagtttattgatccattcttgtattgatagatatttgaatgtttccagtttttcctattatgaataaaactgctatgaacattcttgtataaatcattttctggacatatgttttaatttctcttggataaatgcttaggaattagtgagtcatagaatagatagttgtttagttctgtaagaatatgccagacattttttcccaaagtgtttatactattgtacattccaaccattaatgtatgaaggtgagaaagcttttgctacttccaaagaggcctctctatatacatgtaattttttctaactggagacaggctgatgacttcagggacatgagcatgggatacctgtcatcaccaccaccataaagttgggattcaggaaggaggttaatcatataaagaatcctgtgaccagtatgagcttctctcaggccacacagggcactcaagtgaacagggcatgggggccctggggtcatggtaagaaagtgtctcattggtaaaaccttttcctctggggaggtaaataaatgatttgtttcttcttggtagcccttgaagataaggatggtcaaacaaaataatatcatacctggagaaactcagatcttgctaagatttactggttgggaatccaaagttaatgccaagaagcagccgccagttgggatcaaatgtgagcctatggatcaaggtgcgtactcaaacacagagagctttctgaaagatgctaccagtagtttttccagggcagagatgggtcctttatttttctctctaatctagcccatatgcttagctgagttttctttgtatcactttaaatgatgatgtcccttgttcaacaattttctaaacattctttagataataattttatgggcattctttattgcattaggcttaaattttttaatgcatcttaaggttttattgcaaaatattgccttgtttcctttttaagatgatacagtttataatatgcaaatttgttgtctgtcccctccctttatgtacatagaaaatgagcaaacaggtggccatgaaacagatggtcatagaattggttcagtggttgtgagtgcagcaacccaagagtgtcttatctgaaataccaccaggaatgtctggacacagtagacaaaggtttttcaactggacgccttaggatacatgcttgcaaaaacaaagtagccaaaaagaaaccagagtcacagaatatcagagccagaggaacatttggaggtaattcagtacctcctccttttcaacctacaggggagatagtggaagagaagcagggatgggtctgccttctgtgcccacaattcattggagattgttgtggtgaagaatttcttttatgatgaaggagaaataaactcccatcagctttaattcaggcaggtttattgaaaaggtgaagaagcatcttgcagaagcaaagcatggctgaggcttgtgggctatgtctggacaaatgagcagccgacagtggctgatgctgcccctgactctggggccatgcggtctgtggttctctgtgagcatctcttctattctcttgcacgttccctcagcctggcagtctctgtgtactcttcaacccataattgagtgaggctgtaccagccccaatgccatgtagcactttatgtcaaattagaaaggcatgaaataaactaaccctttataatacaactgttggaacaacagttgaaaataacaatatcttgactcctggttgagtgctttacactgagctgtcttttccgaatatgagcacagacttggggatattagtgtcacctagcgttattagctagtattctccttttgtttccccataacatcccctcctccttcccacagatccactctccactcatttccatcctgtcttatgccacttggggcttgtcccttctagaatgcatccctggctcccctgtgtgcacacttgtagttaggtttagcagtgggggcacccgatggagcctggaagtgagaggaaggtgaggtccgtatttcttccctctccctccctgctctggcactgagtatctggtaatagctgcatctgtctattacttcagtggccactcttccacagccccaattctcagtgggtcccatagcattatttacctttgttcctttagctcccatcaaggaagacccagaggcattctcctcaccaaggcattaagaaatgcatgggtgaggggaacagcggcgtgcgtgtaaaggtcctgtggcacctctcctctgcaggctggaggtcatggcgggagatgctgcatggatttgccctccctgctgtcagaacaacagggttctggaagagtagaggacaggccgtgggacttggctgtctagagacatggcgggagggatttccttgagaggcagggacatgtggtggttactaatcattgtgaggtgtctgggatgtaatggatgggaaatctactaagaagtcaacttatgtaataattagaaaagctctagttctgaggacagagacctgttggagtcaccatagtgggaatttttgacctggcatccagttcagatacctggagcttcttgactgaggggagattggatcccttggggaagagtgaagccttcaatgctgccacaagtgtgatccgcccgcctcagcctcccaaagtgctgggattacaggcgtgagccaccatgcccggcctcttttttatatttaaaaaatatcattttgtatattatcagggcaaaagagaaaaactgtatgattaccttgtcatacacagtaaaagcatttggcaaaattgaaaacttttttcatgatttataaaaacaaaccccagaaaatgctcagcatgatgagaacagaaggcaacacttccaaccccattaagggcagatttgaagaacccacaggtaacattatattaaatggcataagattgaatgcttttctattaaatcagagaaaaaagtagaatacctgttattactcttttaattcagcattatactagagctctaaatcaatgcaataaagtaagaaaaattaataaagtattgaaaagaaagaattgaagctgtctttattcacagataatgactgtgtttgttaacaatgctagaaatctacaaaaatctaccagaactaatcagtgagtttggtagtgttgcagaatgtaagctctcaatataagtggtcttttgtatttctgtatattagcaatgagcatttggaaaatgaaataagaatacaatttcatttaaagtaacatctaaatacatgttgtgcttataaataaattcaacagactgggcaccgtggctcacacctgtaatctcagcactttgggaggccgaggtgggcagatcatgaggtcaggagatggagaccatcatgcctaacacagtgaaaccccatctctactaaaaatacaaaaaattagctaggcgtggtggcatgtgcctgtagtccagctacttgggaggctgaggcaggaggatcacttgaacctgggaggcagaggttacagtgagccgagatcgcatcactgcactccagcctgggtaacagagcaagactctgtctcaaaaaaaaaaaaaaaaaaaaaaggaaagtcaacaaaatttatgtaaggccagtacaccaaaaactataaaaaattgctttaagaaattatgaaagaactaagttagtggggagataaaccttgtcatggatcagaagagttgttatgtttaaaaagtcagttcttcgtaaattgatctccagatccaatgcaattctaataaaaattccaaccggcattttggtagaaatttacaagatgattctaccatttatatggtaatgtcaatgatcaagaataataaaatagcaatattataaaagaataatggtgaatgaattcactacctatttccagaattactctacagctatgaaaatcaagattatgtgttttgttgaaaaaaaaaatggaatatatatcagtggaagagaagagagaatccagaaatagatactcacatgtatgtctaattgattcttaggacatatatatatgtatacacacatacacacacaaacgtgtgtgtgtgtgtgtgtgtgtgtgtatatattcaccgttttgaagattatcatctccaaatagggaatatatatatatatatatatatatatatacagacacacacacacacatatatatatatattgcaatctgataagataaacagcacattgaaacaatttctcaaaagacttagatacttcagaaaagaagatacatgaatgggcaattagcataggaaaagatgctccactgtttagtcatcagggagatcaatcagtgcaacaatgagataccactacatatccataagaatggctaaaattaaaaaggctgaaaatagcacctgttggtgaggatataaagcacttggaagtcttatacttgtaggaatgaaaaatggtatggctcctttgaaaatctaacagtttcttaaaggttaaacataacacaaatcagatagacagtcattccattcctaggaatttacacactgtgtctgcacagtgatctgtatgtgtgtttccagaccaacctgaggggcgggctgctatttctcatggctcagtaatgagacacagatgaactggggaggaagagagttttgacttctgcaactggttacagggaaacggcctggaaattatcaccagaccaactcaaaattggaaagttttcctgagctaatgtaccttctaagctatatgtgtatgtggaagtgtgcattcatctaaatacataaatgattaacttcttttaatctataactaagtctgagtcctgaagaccttcctctggaacctcagttaaattcagttaatctaaatgggtctaggtgctggggtcccttatcttgtctcctgctaaatcacagaggtttggagagtcccttcagatctccaataaacttgtttgtggaggcctggggagtttcttcagacccccaataaaactcgtttaatactaaatggctcctgttaagaatgccttcgttatttcgtcatgctttaaggcccaggaaaaacctaggcaaaactcttggtgggcttttgttacattccagcctttgtataagggcactggcttcttttttttttttttcctcttaatatttaattgaaccactcagtcggtactgaaacagttgttagggaggcctgtgttagtgagacctggcctgccacgtatggatgctcatgatagtttcttcataatagcccaaacgtggaatgatagaaatgtccaataataagtgaaagtacaaacatacatggtatagccacacgaaggaatactactcagtatttacaagacattacagatggattttaaaattacattgatgcatgaaagaaggcagacacaaaagaacacaggtatcatttcatttatagaaaatggttaaaaatgcaaacggacctgaagtgacagtggctccttggggctgagggttgaaaggctgatgaactgcaaaggggtacaagaaactttggggcatagggaatttcctctatcttggttgtggcagtagttccgttagtgtatccatttgtaaacgtgcattgaattacacattttaaagtggtgcagtctgttgtaccgaaattatgcctttataaagttgatttcatcatcttaatttctccatactagcaattagcagctagaaaatgaaattcaataaaacataatagagattaacagccagaatcattacatgcttaacaatacatgcaatgaagcaggtacaaggcccctaaaagcaattggtgagaaaaattaaagaaggctaaataaatatatatcatgttcattgcttggaagactcaattttgttagcatattacatcaacacaattctgcttaatatttctagtaggagattttagagaaatttgaaagctagtttcaaaatgtatttgaaaatcaaagaacctagaataagcaagtcggtattgaagaagcaataagttggaggacttactctgctagatttcaaacctgattttaaagctacagtaattttaaaacagtagtaatggtgtcagtattcataaatacatcaaagtgaaagaatacagactcaaacaatatgcccacatatgtacagttattgattttttttagtagaaacttttttattcataaaaaatccatcaaaacaaaaaagttttccagccacacacaggaggggtatgggtgggggaaggtgtctgtccatctatccctggcccccagcccatgtggttttggcagcaataaggtgtgtggagtaatgactcctgaaattaaaatggtgtgtgtatgtgaaggaaaggcgggcaaagctgtggggagcggtggagtggaaggaacaaaggaggtcagtactgggaacgctgaaggtgggaggccatttcataacattacttgtcgatgaaattgccatggataccttctttgcccatcagcaggcctagcgtcttggcagtcatggtgacaatgacgttgaaggtgggggctccaccgatgctcttcatacgaagatccgtggtcaattccccatcctgcagcagtgagtccaggaccacagtatatttctggccccccagtgtcagcccattcatgacaaagcttgaccagtctttgccaaccaggacaccaacctcagctggcgtgatgttgaggaaggttttccctgggacggcggcccagatggaaggcgggtccttgttacccacaatggcagtgtcctaacaggtcccgtccgccacgaggctgtagatggaggtgtccacctggccgttgcgttgctgcaggggctcctctggtcgctgctgctggggccgcctgggctggcgggtgggggaggcggagagctcgatgcaggtgctgtcctcctcgccacgactctgctagctgtgcagtagccctcgctccgccacttaaaaaagaaaaaaatatatatatataatatatatacacgtgttatatatattgtatattatgtatatacacgtattatatatatacacgtatgtatatacacgtatatatattatatatattcatgtgtgtgtatatattatatatacgtgtatacaggtatatatgtatatataatatatatacacgtgtatatatattatatatatatatacgtgtgccatgttggtttgctgcacccattaactcgtcatttacattaggtatttctcctaatgctatccctcccccagccctcaccccatgacaggccctggtgtgtgatgttccccgtcctgtgtccaagtgttctcattgttcagttcccacccatgagtgagaacatgcttgcaccgccgcttctaaatgttttaaaaacagacaccaatgcccttcattggggaaatgaaagacttttaagtaaaacgattttgagtgaaataatatttgttgttttaaaaagttaatattaaccactctccatcatatgttgaaattatcttaagatgtgaaagttaaaattagaaaccttgtaaaggaaaaataggaaatagtttcatgaacttgacacaggaaaatatttcttagactagatactgtagcactcaccacaataagaaatcaagcgaattgcacttcatttttaaaaagcttctccttattatgttgttgtttaacaacttaaacgctatctctagaccaggaataattatttgctatataatacagcaaaaaatatgtatgtataaatggactcattcaaaatatataaagaactcctattacaaagaaattgacaaacagcccagtatatcaatgaatataaaaatttgagaagatattttccataagaagatatctaaatgaacattaggcatgagaaaaccaaattttaggatatcactacacacctggcatagtttaaaagactgaaaatattaagtgtgtgggaatgtagagcaactggaaatggcctacatctttcatagaaatgtaaaacaatacaaatactttgcaaaactctgtccaacattttctacccattcaccaagcaactccatccctagctatagatacccaggaaaataagtatgtatcttcacagaaataattgtatgagaatattcatagttacttatgcacagtagttatcaagtaaacctgtctcccatcagaaaaatggatatcaaattgtgtgataatcatacaatcaataggatattacttggccaaaacaaaatgaaacaagggaaaaacacaatcaaacaaattagtggcatatatacccacttgagtaaagagaagtcggccgggcgcagtggctcacgcctgtaatcccagcactttgggaggccgaggcggcagatcacgaggtcaggagatcgagaccatcgtggctaacacagtgaaaccccgtctctactaaaaatacaaaaaaagaaaaaaaaaaagaaaagaaaaattagccaggcgtggtggcgggcgcctgtattcccagctacttgggagtctgaggcaggagaatagcgtgaacctgggaggcagagcttgcagtgagcctagatcgcgtcactgcactccagcctgggagacagagtgagactctgtctcaaaaaaaaaaaaaagtcaaaacaagagaacatactaaatgattccatttttttatttatgacttcatgactaccattaagaaaatataacctgttgggaaactgtttctgccttgatgatgttgtacagacaagagataaacagtgaggaatgtgcttagatgtattgggaaagacacgggtctgtggcattgtcacaagggtacacgaatactgagagtgaatgctgaaggaatgatccccattggtggtgaccctcaggtgagactagggtgcctgtgtttcagcaaagcctgggcaattggaatgcagggctcctaagattccatgacacccccaccttctaattctgttattgcaactgcagaccgttacctggcacgctggccacaatctacctcactcttatcagagtctgagctactggcagtgctttcagctctgagttgaggcacctcgaaccttgtttttgtggtgaaggatcctaaagtgctgtgggagtgatcacatttttcacaacagtaaggtaagaatttcagttactgacatccctcagtcctgattaaacctatttgatttcaccagtttttaacccatcatatgtttgagtttcttctccccagtccctgactccacctcttctgccacaaacgtcagcatggtggtatcagccggcccttggtccagcgagaaggcagagatgaacattctagaaatcaacgagaaattgcgcccccagttggcagagaacaaacagcagttcgtaaacctcaaagagatgttttctaactcaactggccggcttcctggccaaccgacagaagaaatacagtaagatctataggctcaccgtcatgaaagtgatgaatgatgtcctgtcttctctctgagacactaaatgctctctccatcaaaaataatttcatccttcctgtacttctaggaaaacagaaatgggtattttaacattttgttaaagttggaagacagaggtaccaaagtatttagcaactttccatgtttgcaatcagatgggggtgggactagagttaaactcacagttattgatttctaacacaggcacagaacgacctgttttctccaagaggctcaatcatgttttcaagaatcctctctgtaccatataagatcctgcagacaaataacatgtagtctgttgttctaaatgtctaggactagtgaacttttattcagttcaagtttctgttgaggcccaacaggcaaagctctgttctagtgactctgaggggaacttggtgatagtacccagtacctgctctgaggggcttcaagaggagtctgctcctaatagaacctgtgctatctataagtgacagcatcaagagcagggagtaggggccgtgcaacatggctcactcctgtaatctcagcactttgggaggctgaggcgggcagagcacgaggtcagcagtttgagactagcctgggcaacatggagaaaccccatctccactaaaaatacaaaaagtagatgggcgtcgtggcgggcaactgtaatcaccactaatcgggaggctgaggcagaagaatcctttgaacccagcaggcagatgttgcagtgagccaagattgcactattgcactccagcatgggtgacagggcaagactcgtcaaaaaacaaacaaaacaaaaagataaataaatcaaaaataaaaataaaaagcagagagtagcttggtgagagtgaagtcctgcttcctggtgcacaggctcttgttcctaaagaggaagaaagatcacacccgagaatgtgtggaagcagcagtgcagtgtgcaaagcagggaccctcagcctgtctcctgggctccatccaagttccttgtcttgtctgtccctcagtttcctcatctgttcagagggtactacaataatacctacctctgtaaattgctgcaatgaattacatgaggcatttcctgtcaatctccttgaacattaattggcacagtgtaaacactatctattagttcttcattctgatgtttctaaattaacacaaactaatcttatgctgtttctaaattaacacaacgaatctaaatcttaatgctgcctctcatactaataaagtatttgggcatatttccttcatggccttattgtcttatgtctcacactttatgcttcagatatgattcttaaaaccatatctgaatattgatttaaaaatgaaatatttttaaagtccttgacatatttgtccttgaaatacccagtaaaagggaaaccatcagtcccatagtcctagggaccttcccgactgtacaagaaatcactacttcatgccccagtgcagtgttttagaggagaggctgcaaggcttgggaaagtggccccgcattcggagtcagacctcaggggctgtgagttctgactccgcttcgttgtggttgaatcatcttgtcaacttccttgacacgcccttgagtttctctttcttcgtctttaaattttggaggatcagatgccagaaagtcaggagactgaagagtaaagatgtggaaatccctgtctagaccctggtactggggagagttttgtccttgggatggacctggctcctgccctgtaggcagtgaccacagcagcatgtccagccttcaactgaggcaggcgtgtctgtcttttctcagagtatgaagagtgtaaagacctcataagatttatgctgaggaatgagcgacagttcaaggaggagaagcttgcagagcagctcaagcaagctgaggagctcaggtgaggggaacccgtagggggaggcaggcgggtaggtgtgtagatctctgaagtacagcagctcggcggggagaagtaagaatgaagctgggccaggggaagggcagaaattgccatggcaggctcatgacacacaaatatttatcagagaacaaggataataataagttctgtgttgcagttgtttcttagagccttgttttctctttttcaaacaagtaattgttgaggtgaaatttacataacacaaaattcaccaaaggagtgggaaccacccagcagcattcagtataatcaaaatggtgtgctatcgccaccccacttacccttagtgagaatcaccttctgactgactgcgtcttctcattctttcactcaatcaatgttgccttcttgaccctgtcattcttttcttctttcatcttttcaattcgccccatctgcacctggcctcatttctgtacatgactttgtatctagtggccgcaagatgcactatgtgtattttcacatggaaatgcccatggccagagtgaggaactgaaaggatgtctttgaaacggaattaggaagacacctacttttgtttacagaagagaaagatgaatggaacatcatcgaggatcttgcaggagccctctctgatacagggaaagcctgtagaccattttctgttctttctcttggccacagacattcctttcaacatgtgctgaccttctgcttgaaggtctccttgtgaacattgtctcagaaatctctgttgcaatatttgaacggatcactcaaccctttctactcttaaattttctctaccgtctcaccttaggcaatataaagtcctggttcactctcaggaacgagagctgacgcagttaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccaggtaaggtggccataggccctgatgacccaaaaccccaggcttatgagaggctccagatctccatactttcacaatgacagttgtatcagtggggtttttttctgctacacctatgtggccatgacatgaccaggacttcctgggtaagaacagagatgggaaacccatggtttggaggtcacagtattgcaagtgtccctccttccttgatggaaggtggtctttggagcaagaggcagcatctatctagttttaaaggacaagaaggaggctgtgatgggagggcgcttgttggagtgaaaagagctctgggctaagaatgaaggttcccaggctgtctttttggcaatgttcttagtaagtgtcggtgagtgagtgatttatctttccagagtttctctctctccatctgcaaaggcagacaaattgtctcttgcaagggtctgaagcatccaaatatgggaacacttacgaatgcttttcaaaatgagatgaagcccctctccatgtggtgttggagaaggcacttgatgtgggggcatttggtggtaggaagtgcttcagactggagcactccccatggatagaatgtccctgaataacacagcagaagccacatggagggcctgtgcagtctcatgacgcatagaggactgtgggacaagtttgtcctctcctaagagaaagaatgaggtttgaaatgcgaactgtgacaggacaccaagcctgttcctgggaatcagatctgtggcaggatgggggagacagctgccaaagtccagagagaggctacacaagcctccagtgatatgggaagcaaaaggtcttttcagtatttggccacatcttgatggtggccctccacatcagaaatgcattgcccgatggaccaggaaaccatgccagggcattttgtgaaagataaaacatgagagttttcagtacaatgctgaaccatacatagatgttcatgtctctgtgcacgttgggctgactgtgcttgcagaatgtgaagtgggaagtatctgaacgaacattttgtatttatagaaaatgacgaagatgaggatgaagatgttcaagttgaggaggatgagaaagtgcagaaatcatctgcccccaggtaacactgaatactcaggagcaagtaatgggtggtaacatatgaaaatgtctaggaggcacaacctctctggcatctatggtggaccaaaagcccgcatccccttggccacagtatgtgaaattgaacccagcttagacacagggtgcggcagctgtcgtgtttctctatgtgtgccaagtgtcatgtctgtaccatacagggatagctgagtcttcatcctcctcagctcctatctgtccagtgcactgaataccagctgctctcttcctctctggctcccatggcagccatggtctgttgcagagagaagaggattgcctgtttcctctttaagggaacctccattttgctttctggaaccactctcttaatgccacctgtcaaaaccagctaggactccctggggtccaatccctctgtgtttaatcttctgtcatctctgtcccacctggctcatcagggaggtgcagaaggctgaagtgagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccaggtagcctctattttccttgtgtctcatacctctgtctaggctatggaagattaattctgaggacaggctgtatatacacatattgttattgttttagtcagaaactaggatggagctaggtgctgtgactcacacatataatcacagcactttggaaggcccaagtgggacgatgacttgagttcaggagttgaagaccagcctggacaatatggtgaaacccatctttacaaagaatacaaaaaattaggcaggcatggtgctgcatgcctatagtcccaactgctcaggagacttaggtgggaggatcggctgagacgatcctcccacgctcgttcactcctctcaggctagactctctctccttttcattggcttgtcttagctattaataagaagtctcggcctggcgcggtggctcacacatgtaatccgagcactttgggaggccggggcgggtggatcacgaggtcaggagatcgagaccatcctggctaacacggtgaaacgccgtctttactaaaaatacaaaaaaaaaaaaaaaaattagctgggcgcggtggtgggcgcctgtagtcccagctactcaggaggctgagacaggagaatggcatgaacccaggaaccggagcttgcagtgagccgagattgtgccactgcactccagcctgggagacagagcgagactccatctcaaaaaaaaaagtaagtctctgaccaggggcgctggctcacatcttaatcccagcactttgggaggctgaggtgggcagaacacctgagatcaggagttcgaaaccagcctgtccaagatggcgaaaccccatctctactaaaaatacaaaaattagctggcatgttacttggcgcttgtaatcccagatgcttggcaggctgagggatgagaatcgcttgaacccgggcggcagaggtggcagtgagctgagattgtgcctctgcactgcagcctgcacgacagagtgagactccgtctcaaacaaaaaacaaaaaaccaaaaaagaaaaaaattaaaaaagcaaaatgaaatcttttgtgctacacagaaacattggccactcatggggtaaaaatctcagggccaagccttgctttatagaaacttataagcaagaaaagtgtagaagtgtttatgtcctggtttcaaggtgactgcatagctgagacaagttgacttaaaggagatcaagactggagatgacaagagtgaaaccagggaaacatcatcttcaaataagtaaacaaggctgccagtgacatccctcagtcctgattaagcctatttgatttcaccagtttttaacccatcatgtgtttgcctttcttctccccagtccctggccccacctcttctgccacaaacgtcagcatggtggtatcagccggccctttgtccagcgagaaggcagagatgaacattctagaaatcaatgagaaattgcacccccagctggcagagaagaaacagcagttcagaaacctcaaagagaaatgttttctaactcaactggccggcttcctggccaaccagcagaacaaatacagtaagatctacaggctcaccatcatgaaagtgatgaatgatatcctgtcttctctctgagacactaaatgctctctccatcaaaaataatttcatccttcctgtacttctaggaaaacagaaatgggtattttaacattttgtcaaagttggaagacagaggtaccaaagtatttagcaactttccatgttttcaatcaggtgggggtgggactagagttaaactgccatttattgatttctgacacaggcacagaatgacctgttttctccaagaggctcaatcgtgttttcaagaatcctctctaccatataagatcctgcagacaaataacatctagtctgttgttctaaatgtctgagactagtgaacttttattcagttcaagtttctgttgaggcccaacagacaaagctctgttctagtgactctgagggaaacttggtgatagtagccagtacctgctctgagggcttaaagaggagtctattcctaatagaacctgtgctgtctataagtgacagcatcaagagcagggagtaggggccgtgcatggtggctcactcctgtaatcccagcactttgggaggctgaggcgggcagatcatgaggtcaggagtttgggaccagcctgggcaacatggagaaaccccatcttcactaaaaatacaaaaagtagatgggcgtggtggcaggtgactgtaatcacccctgctcaggaggctgaggcaagagaatcctttgaacccaggaggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaagaatgctgaactaacatgaaaatcaggggctgggaaaatgctggattgagaataatgtgataatgaaggttttatatatattcatatattctcttcaacatacataatgccataaaaaggataaaacgcctaagtctagtcttgacagagcaccagcttaaatcacatgcgcctatcagagaacttataacaatatttagggctaaactgatgttactggtgaaccagtatctggaatgatttccataactcacttaacttgcacatttataatgtggactttaaataataattatcaggatggctactctgaagccaggagcttaggaagtgtcacagatggtatatatttgtattcctgcctcatgtccctttccctgaagtggcgtgtggagtatgagggattacggtgtatttgtaggtggtgtccctgaaaggctatcaggggacttctggttctgcttcagttctgttttgtgaagacggtcaagtgatttaaggtctcttgcttcagccatcccacttagaaagcagttgctttatagtcctttgggtatatacccagtaatgggatggctggctcaaatggtatttctagttctagatccctgaggaatcgccacactgacttccacaatggttgaactagtttacagtcccaccaacagtgtaaaagtgttcctatttctccacatcctctccagaacctgttgtttcctgactttttaatgattgccattctaaccggtgtgagatggtatctcattgtggttttgatttgcatttctctgatggccagtgatgatgagcattttttcatgtgttttttggctgcataaatgtcttcttttgcgaagtatatacccaaaggactataaatcatgctgctataaagacacatgcacacgtatgtttattgcggcactattcacaatagcaaagacttggaaccaacccaaatgtccaacaatgatagactggattaagaaaatgtggcacatataccccgtggaatactatgcagccataaaaaatgatgagttcatgtcctttgtagggacgtggatgaaattggaaatcattctcagtaaactatcgcaagaacaaaaaaccaaacaccacatattctcactcataggtgggaattgaacaatgagatcacatggacacaggaaggggaacatcacactctggggacggttgtggggtggggagaggggggagggatagcattgggagatatacctaatgctagatgatgagttagtgggtgcaacgcaccagcatggcacatgtatacatatgtaactaacctgcacaatgtgcacatgtaccctaaaacttaaagtataataataaaagaaaaaaaagaaaaaataaataaacttattgatcatctatgtgctaggcatattctctgtttgtatatattggaacatgaaccttccaggtccttgaaaatgtggtgggtactaaatgaaatgtttccagttgtgattcttttttttttgagacggagtcttgctctgttgccagactggagtgcagtggcacaatcttggctcactgcaacctccacctccctggttcaagcgattctcctgcctcagcctcccgagtagctgggactacaggcatgcgccaccatgcccaaccaatttttgtatttttagttgagatggggtttcaccatgttggccaggatggtcttaatctcgttatccgcccgcctcggcctcccaaagtgctaggattacaggtgtgagccatgactcccaggagaaataactttaaaaacttaaaaacattgggctgggtatggtggctcatgcctgtaatccctgtaatcccagcactttgggaggctgaggcaggcggatcacctgaggtcaggagtttgagatcagcctgaccaacatagtgaaaccctgtctctactaaaaatacaaaaattagctgggcgtggtggtgcacgcctgtaatcccagctactcgggaggctgaggcaggaaaatcggttgaacccaggaggcagaggttgcagtgagccgagatcttgccactgtactccaccctgggcaacagagcgagactccatctcaaaacaaaaacaaaaacagaaacaaaaaattaaaaacattatacaaatgtaaactgcaatgatgacaagaaagaagaatgtggactccatatgaaattccctcttggtatctgcactagaacatctctacttttcttaagcctcaaactttgctcatctctttgacccttagtctctacagaggatctgttctcctactctccaaaattgttcaaggtcatctgatgagtggcctcaatttattttcagatgtgcatgtgctttacttggggttttgttttgttttggtttttagttcagttttttttattggggttcaaatatgagacagtcttggggaacctagtagggaaaatctgaaagcaaatacagtgccatactgagaattgtacaatatgtgtgtgtgtatatatatatatatatataaaagaaacaatacagaaacttcattctgctatcacaaagccttcaaagaaatgacgattgatgccttagtgaggttcactagaagggaaaaagttggcagatgtttcccacagaaggaaaagcatgagcaaaattctggagacttgccatagcttcttatgcttctggaggcagtatggcttcagggtttggatgtcagcaatccctgaaaccatgtttcacaagtctccagatgccaattttttcattaataaagtataataattcatatctcatggggctgttaaacaagaacataaagtactcagctgtatggtaagagctcaacaaagcttagccatcattattattactagcctggcatgaatgaagttaaggaatggtggtgggtgatgagtgtgggagaaatcagaggttacatcataaaaggctttgatggccacattaggagtatggatcttatctcctaaaggtattgcaaagcttcttaaatggctctgccatggtgcgattaaatttatgtcttggaaaggtcacattggtcatggtatgcacatgtggtttttgcctattcagttaaaagctccttaaagctttttatgccaccacagtcttatgcacctaagaggctacattatttgccaatttgttgttgttgaattatctatttcagaactactctgaattattaggttgagattgaatgagaggagcaggactggaagtggagaggacatttagaaagtttcctcggtaatccagacagtagatggtggtgacctcaacaattgcccagttaccttcaggacaaagtccaagttccttataatggtatacaaagctggcacaatcagacacctattctcaaaacagcttacctctcacttgtcttctcacttgctccagttatgtacaattatttaaagttcttgaaatactcctttccctgtgtcttccctccatagtttctccttctgcatagaatatttcctttccctatccactttctacctatttattctacctcctattcatccttcaaagctcagctcagatttcacttcctctaggaaaccttcaatggcattatcttagtctttttgggctgctataacaaaacaccataaactgggtggcttataaacaacggaaatgtatttctcacagttttggaggctgggaagtcctagatcaaatcactgacaggttcaatgtctggtgaaggttcacactctggctcataacggtgcattcccactatatcctcacatggtagaaggggctaactagctctctggggtctcttttacaagcgtattaatcccatttatgagggctccatctccaatgtctatgatttaatcacctcctaatggctccacctcataatacttctggaggcagaagtattaaccttaagggttaagatttcaacatataaactggtgggggagggaggtggggatgggacacaaacattcagaccacagcagacaacttgctcttttaatgtggaatggatgaccctccaatatttccccagagcaccccatgctcttctatcagggaacttattaaaatcatgtaacatgtttcttggtgacaagatttaggtcttttgtttctgtaacacatgccagatacttagcccggtatctggcatgtggcatgcccagtaaatgtttgctgaataagtgaatctatgtctcttgcttgccgctatttgcccactgaatccatgaagtgagttttcataatgattaccactgaaaattcaaccctgaaaagaatgtcttcggttgtgggcccataaagtcttagaaatagtgaagctcctactgtcagtccttgaaagggaacaggacagctgctgtatgccttgagaatgggcaaaagacaagcgacaaaaagagcagcgaaggcacctacttgtccctctgggccagggcctcagtgtattggtcgggcttgacctggtctcctggtacatcttcccagtttttggtgactcccttcagtttctctgagagctccaggttacactccttctctgcttccaccagagctgccatccgcgcagcttcattctttgctagcctggattcctggaaaaagaacaaaaactgagaggctgcaaaatttctacctagattaggagccctaagacccaggaacattgatgaatttcagagggaaagtagagacggaaaaggtgaatgccagaaggcagagcagtaggaagaggagtgttaataaaagagaacccctacctatggactttgggaactcctcacctcctgcagaagctggatcttattctccaagagctcataaacatgctccgtctcctgctgtcgctcctcaaactggcgtcggagctcagcttcattctgactgttgagattctccacatcagccctaaaaccacagagcattagccaatcagagccagacatacagtttagcaagtggaaccattaaggttgttctttgataaatctccaaactgctttctgcagtgactgaactggtttatatttccaccaacagcgtgtaagcattcccatttctatgcagcctcaccggcatctgttgtttttagacgttttaatagtagccattctgactggtgtgagatggtatctcattgtggttttgatttatatttctctgatgattagtgatgtggagcaatttttcatatatttggtgggcatttgtatgtcttcttttgaaaagtgtttgatcatgccttttgctcatttttttaacggggttatttgtttttcattgttcaattgttaaattccttatggattctggatattagacccttttcagatgctagttgcaaatttttttagattctagaggttgtctgtttactctgttgatagtttcttttgctgtgcaaaactctttagtttaaataaatccgacttgtctctttttgtttttgttgcaattgcttttgaggatttagtcataaattcctgaggccaatgtccagaatggtgtttcttgggttttcttctaggattcttatagtttgaggtcttacatttacatctttactccatcttgagttaatttttatatgtgctgaaaggtaggggcccagtttcattcttttgcatatggctagccagttatctatcccaccaccatcgaataggggagtgctttccccactgcttatttttgttgattttgtcgaagatcagattgctgtaggtgtgtagctttatttttgggttctctatttgcttccattggtctatgtgtctttttttttttccagcaacatgctgttttggcaactgtagccttgtagtatagtttgaagttggatagtgtgatgcctctggctttgatcttggtcatttgatgaatgacattggtagtttgataggaatagtgttgaatctgtagattactttgggcagtatggccattttaatgatattgattcttccaatccatgagcatggaatgtttttccatttgtttgtgtcatttatgatttcttttagcagtgtttcatagttctccttgtagagatctttcacctccttggttagatgtattccagggtattttttttttagcggctattgtaaatgggattgcattcttgatttggctctcagcttgaatgttattggtgtgtagaaatgctactgatttatttattttttttttttgagacggagtctgcctctgtcgcccaggctggagtgcagtgatatgatctcggctcactgcaagctccgcctctcgggttcacgccattttcctgcctcagcctcccaagtagctgggactacaggcgactgccaccacacccggctaattttttttttttgtatttttagtagagacggggttcaccgtgttagccaggatggtctcgatctcctgacctcgtgatccacccacctcggcctcccaaagtgctgggattacaggcgtgagccaccgtgcctggtgaaatgctactgatttttgtacattaatttttgtattctgaaactttattgaagtctgaaaatatttttaataattttagtaatacttgtcatttaacactaagcttttaaaaaactgtaaattacaaaagtaaccattttagcaatataaatatatataaagaaaaatatcaagtcttatccctatcatggactgtgatctcactcttcctcaatatactataattatcactcagcaacttttcccccttactttaatcaaggaattcccactaggacaataatatagagctaacttattcttcaataactgcataatagtccacagtgtagtaataccaaaatttattcaatcaatgccctattgatggataattgtttctagttttttgccattacaactaatgatgcaataaacatccttatacatttatcctttcacactaacgcttttatttataagaaacagattccttctagggattgtttgatcaaaggaaatcctccttttttactataataggtagcatcacatactaaaaatgttgtcacaatttacactcactggtagtgtatgagagtgcccattttccccaaacgttatctcagctcttgatgttattataggctgactgatactttttgataaagcttatttgcatttgtctctactaaaagtggaaacattcactgtttcaatttagttgattgctgactaataggaagtttgcaatcttaggtctggtggatttaccaacttatgacaaggtccatctgacctagtaatagagagagagcccaagggaaacacagcatatgaaaatctattgtttcagttcctgaatcagacacaggattcaaatgccacagataggttaaggaatttggttccaaatctattgctctcagattagtaagacagactctggaaaggaccagagcttaaaattacaacttaccatgttttatccagatgctgtttcttgtcctggagttctcgtttcaagctctccacttcaaccttcagctcagtgttctgaaaaacacacaggcattaatcgttattaactgccacagacactctttcctggatccaggttcctatttgagtcttgccttggtccacagcctctcacttcatctctgccctctttgtgacccttgacataattagggatttagttggatcagcaatctagtcaaggaagaataaactgtacagcttcagggtttcccctgagctacttatcaattttcccaacctatttatcattacccctggatcatgaacactgcttaagtctattcgttctctaaaccattgcaggacagagtatatattaaaataaatttttcctatctaatacaggttgttcccgaaaacgaaattgctagaataatacttttaatagaattatagtaatagaacaatacttttaaatgcctggggattcaattatttaaagaaatttggttgtaaacatttttaaaaacaatgcttttatcataaaattggaattttataaattaggtttgcttaaggtgagaggggactctgatggtaaagttatacagggaacaattaatttttattgaggtgaggatgcaacaagtaagatttggggaaacagaaataaggaaataaaaacatcccaagtgtgtccggtgcaggttaagtggcttagtgtgtggtaaggagtatagaaaatagtttgcaactagtttgtgaaaatcctgctaagacaactagataggccggccacggtggctcacacctatagtcccagcactttgggaggccaaggcaggcagatcacttgaggtcaggctttcgagaccagcctaaccaacatggtgaaacctcatctctgctaaaaatacaaaaattagctgggcgtggtgacatgcgcctgtaatcccagctacttgggaggctgaaacaggagaatcgcttgaacccaggaggtggaggttgcagtcagccaagatcatgctgctgcactccagcctgggtgacagagagagactctgtctcaaaataaaaaaaattaaaaaagtaaaaaactggataataatcagtagaaatcaaagacttatcagggagctttaagcaaagcattggcatgatcgggtccatgttgaagaaggaattatgaagaaggtgggtgggtcaggggcaactaaccagaatagggagggggactgtctaaggacaagaggtacagggagaaagactcaaaagacatttcagagacagaagccacaggccttgatgacttgtgagattcagattagactggagggaggaccaaagacaatgctgaaatttccagcatgtcagtgggaatgcattctattaactaaaataggggcaggtttgtaggggaacctaaggaggtttctgcaaaatgttaattgagggattactttatttcagcttaaacgttagcatgcaaagatggattagtcccttccctgatgaagtccataatacagtattaggcaagaagaatgttatttagtaaagaagtctttagatcagaggttgacagagagactgaaggtaaagtagctaaagtatgaaaagtagtattgtgggtactagaacagtagggaggattttactttactatcgccatataataaccaccaacacctagacttctagaagtccaaggcaacacacaatagcagcatattttctaccatacttgtgaaggcatttcataacccatgtttccatgcagggtggttgaaacacaaatactaattgggaaaagtagaaacctggtttagatatttgagagttacttagaattaaagaattttagagctggaaggcagttggactcaaggcattttagatcatattactagtacgtttttagtgacatactgagaagaatgtttgttcccctcataagtaggtaccttttgaccaaggttagaacatagattcagatccagtgagatgaaaatgtcctaatttcttcaaaagaagggaatgatagccctgtcttttcaggatatcctttaaagttattattttatgaacactaaatagcattaccagatttagcaaataaaaatataagatatctacttcaatttaaatttcagataaacaacaaataatttgtttcattagaagtatatcctttgtaatatttgagacataacttaaacgctaaaacattgtttgttgtttatctgaaatttaaattgaattgagtaccctgtattttattctgcaatacaaataccaaaagattaacaaatggaaacacgcatatttcaattttgtatgaagaacaagtctaagatctctatatcagttccatggcctggcactgcaagaataattcatctgtaccaattgatgaatcagtaaaatagaagatttgctaaacagttgctatgtccccagctttgtggtcaatacttaaaggaattcaaatgtcttcataaaaaatggtccctaagctactggcccttcatagaggtgaaggaatatgcattcaattatgtgggaaatgcaaagagggagcaatttcctaatctgtaataggcagataattgtattttcctcattcataaacctacctgagaggatcgtgaggcataaataaatcaatacatgtaaaggacttaggacagtgtttctaacacaggtataactataattttaattataataatattattatcaccatcatcatcaagaacaacagcattatcatttggaacagcagtttgctttccatgagaccataatgtttcaagtggattcagtgttcaggatatggtgctgagaaagaggactcctaagtttattattatttctgccaccaattgattcacttctgtgaccttgggtaaaattctgctaaggcttctccacctggaaaatgacaaagactgggcaaaaagctatttaaatctcatatgaaagaaaatggaatctataattatgaagtgttattatcaatgatattcctatgcctggctaatttatataaatcagaaaagtctggatatgctaaaccacctcagataagccaaaactgcttgagcagattttttaaaaatctcatatctaaaaatacgtgaggtctcaaatgactggagctatatggatgtcctctgcctagttcttagtctcatgatgtgacatagggaatctctatgaggtataaactgatcaacagaaagttccctgaaaagtcccttactattaatactatttttgcatgaggaatctttgaatattcaaataaaaataaacaaacaacagggaaagtgagaggcactatgaaaccaacctaaagccagaaagaattaggttcaaatcctggctctatcactttcctgctaggtgaccttgggcaggttaactaatcactatgagcctcagttttcttataagtatagtgtggttgctttgctttttaatgaagataagtattcacgagggattctgtgaggattgaatgagacaatgtgcatgataagcatagaacaatgccttgcacacagctgtgcaacaaccttgattcactttcccttcatgtccaggctaactagtgccagtcagagacctcagccttaccaggaaaaatacttagatctaaaaggaagaaaaacagaggacataaattagtacgttctatctgttctaaatcctactgaagaaaatgaagtcaatgctttgaccaatttgcccaaagattcacagatttgaagacctcagcatttctgtgttctagttctcttagtttaaagacaaggaaattgaaatccagaagggttacctccaaggtaaaagccgtaactgaaaccaacactccactcttgctttagccttttatcagagagaccagcttagcaaacactgcccagttttgtctgattttgtagaatgtggtaaattatagaattagagaatgtgctgcatttagtcttgaaagaatatatggaggcagtaagtatagtggtcaagagcataggctctgaaggcgagaagggggcttgacaagtcacctgccctctctaagagcctcattcacctcatctatcaaggagataacaatgataccaatctacaaaggatgttagggagactaaatgaaattatgcacaaaaatcacatcgcacagtgcctggcatgcagtcagtattcagaaaatgataactattattaactataaaaacaataacaatttaccctctctaactaggatagctgaaatccagaagggttttcaaggttaaaagcaataatcttacatcaaagtctaacctttttgcaccttctttctgtagaaaaatcatcatatagcttatcacatttattcattctccattactaaatattcatgtgtaaattgttaaattcttttatagcatcagtagattccaaattaactgcatttgcttattttatcaccaagtcttcttggctctttgtcaagatatctaaggaaatttatgtactcaagaaaggggagatgggaagaaagcacttctctttcttcatgcctccaaaggagtgttcgcccatctaactcaagaaaaagtttcaatgatgaagctgaaattaaacttctattaggtatttcttccttctccccaggactggagtacatgaatagtctcatatctggtttccccaacctcagtccctctactacttaaatttttcctaaagcatagctctggttatttcattccgtctgtccaaaaagcatttaatatgtgatgcaggtccagctaaagaagaaaaaggaaagaaagaaaaaaccttttaacgatttttaactgtacagcgattaaattatacacaactggcctgataatagagtctattcaaaatttgacctcaatctacctctccagctttatcttccattattatctgctagcctaactggatttcccaaacatgccctatgcttcttggtgccacatcattgtgtgcccttcagcttcatggttaaatgctacgtcccctgtgaagccttactttatctctccaaattaaaagtaatttctcatgatgacattatgagctttcaaatattcttttcatactgcaacattggcatcctgtgtaaatgcttcatatttctacacctgtcttatttacccttttaaattgcaaactccctaaggacagaggaaatgatggtgtggcagaactacccaggtgcgctggttattaagatactgcctctcagcgttgtcatgctggggcaggaatttcaggataagtaaacctaggttcacatacctttctgccacttcctaactgggggaccttttttgtgtaaattactgcaacttttacaacctaatttcctcatttataaaataggggttgcaaaaattacctcaaagtttgtagtgaggaataaatgaatttatgtaaagtacccagcacaatgtctgatacaaataaccgcagctcgggcgcggtggctcacgcctgtaatcccagcacttcgggaggccgaggcgggcggatcacgaggtcgggagatcgagaccatcctgcctaacacggtgaaaccccgtctctactaaaaatacaaaaaaaattagccgagcgtggtggcaggtgcctgtagttccagctactcggaggctgaggcaggagaatggcgtgaacccgggaggcggagcttgcagtgagccgagatcgcgccactgcactccagcctgggcgacagagtaagactccgtctcaaaaacaacaacaacaaaaacaaataaccggcagctgtgactaatctgaggtcctcgcagtgtctctcacctcttggtgcagtaaaagcattgaaagagtgaaccaacaagagaacaaagaaggaatagttgacaagaggcggaagtggactaacaatgatatgtttgttgaatgagtgagaaggtaatagataatgctgtgagattatgtggaaaactttttatctgaagtctttaaaagacattctcacttttggctgggcgcgggggctcacacctgtaattccagcactttgggaggctgaggtgggcggatcacttgaggtcaggagttccagaccagcctggacaaactggtgaaacgctgtctctactaaaaatacaaaaattagccaggcgtggtggtgggtgcctgtaatcccagctactcgggaggctaaggcaggataatcgcttgaacccaggaggcagaggttgcagtgggccgagattgtgccactgtactccagccggggtgacagagcgaaactccatctcgaaaaaataaaaaatgtactccagctggggtgacagagagaaactccacctcaaaaaaataaaaaataagggctgggcacggtggctcacgcctgtaatctcagcactttgggaggctgaggcaggcggatcacaaggtcaggaaatgagaccatcctggctaacacggtgaaaccccgtctctactaaaaatacaaaaaattagccgggtgtggtggcgggcacctgtagtcccagctactcgggaggctgaggcaggagaacggtgtgaacccaggagtcggagcttgcaatgcgctgagatcgcgccactgcactccagcccgggtgacagagcgagactccatctcaaataagtagataaataaagactttctcaggtttttgttttgtttttgtttttttgacagtcttgctctgtcgcccaggctggagtacagtggcgcaatctcggctcactgcaagctctgcctcctgggttcatgccattctcctgcctcagtctccgagtagctgggactacaggcgcctgccaccacgcccggataatttttttgtattttttgtagagacagggtttcaccgtgttaggcaggatggtctcgatctcctgacctcgtgatccgcccgcctcggcctcccaaagtgttgggattacaggcgtgagccaccgcgcctggctgactttttcagttttaagctaagaatattctctaataggtatattattgacccattgacaatagaagattgaatacactttaggattccagcctcctcttctactgctcatgctctccgtaagaagggctaaacatcctactcctgtgcactacattggagctcagaaatactgacttaaaatctccagatcttaacacggacttttaaagggaagattgagtatggacccagtattagatggtattatggaattatttttaagctttttgggtacaataatagtattgtggttatgtttaaaaacaaagccttctctgtgagagttatattctgatatcttcccaaataaaattatatgatgtcagagagttgctgtaaggggtggaagaggacaagatggagaacgaacagtgcagggagatcactgaaaagaacagcaaaatgttgggaaccgttaaagctgagtgatgggaacatggctccctggtaaatgggacacatacatcgggaggtactattttcgtagtctttgtttatatttgaaaattttcaaacttacataatgagaagtcaaaaggggcattttcatcccaaaaaggcaaatgtccatattcttttttattttttcattttcatttctggaattacctaaactcaggttatagatagcaatgaaaattcggctccctgtggcagcttctttcagccaccagacttacatagactcagtggtgcagagtccgtttcccaatactgagggataaagaaaattaaacctgcctctaggcacgtctcaaacttgggagactcagaatacaacagagtatgggatatagggaggaaagaagagatgcagaaataaattaaaaacaagatttgtttaaagaggaactgcaacttctttaattgggcagattgaaccaataaaagcacagttctctcccttcacctcttatcctttagtctcttcaactttcacattgcttcactcactctcttcctctccctttcacctgctcaccttagccaacttgaactgtgccctctgatctgacacaggatgacaatgacatcagtcattacccagcagccattttttctgataactagagttctgagtgatgatagttcatggtgagataatttccaagacctcgctagccattggtggtactactctccattaaagacaagggcatttgctgattgagaaatcaatcatacaagtgtccttggaggccaccaaggctttgcctgaactgttctcagcctatgatggtttctctttctaaacctgttcttctaggttcagctcaaacatcctctcctatagaaacctttccccaacctcccagtcagaactaataatttcttttcacttcaactgtacttagtttataatttatatgactataatttaataactgagactcttctgatagtacaaacaggtgctatcataattacctctgggcaacaggcaaaaatcaagattgtccttagtaaaccaggattcataccaggtcatctgatgtttacctctagtatagcactcacccgactctgccttacattgcttatttaaaatgtctgcctccccttctaggttttataaaagttcttggctcacagtaactcttagtataagtttctgaaataaacactttgttatcacttttgaattgatggcttacatttttgttttggcatttaacttcacatttgtgcattcatgtgtatgcatttcaactcatctgcaagcttatatccctcaaagtttgctgctgggctaagagcagccactcaaaaaataataataggccaggcgcagtggctcacgcctgtaatcccagcgctttgggaagctgaggctggtggatcacttgaggtcaggagttcaagaccagcctggccaacatgatgaaacctcatctctactaaaaatacataaattagccgggcgtggtggtgggagcccagctactcagggctcctcagctactcagctattcagctactcaggaggctgaggcaggagaattgcttgaacccaggaggcggaggtttcggtgagcgaagattgcgccactgcactccagcctgggcaagagtgagattccgtctcaaaaaaataaataaataaataaaaacaaaaaagaaataaatagtttttaaaaaatcttgacagcataccagcatacattcattgataaagtcgacaagaaagtattggagattaaagattgccaaaacctaagtgcttttcttggcatcattgtccttgacctcaaggagttctcagtgtaatcagagttgtgttaaggtcagtgagtgaaggaaatgggtactgcacctttgcaagatagtaggaagcaagccagagaagagctggcattccacaaaagagtctttatttgggacaaaaatcaatatgaccaaatcccatcctaatcaattctgtaaactaaaggaatttttaaaaaataatttagcaggaggaagagtttcaaaatcttgtagggaaaccctgatgtaactcctgattattcacccaaagtgaaaagtaactattagtgaatgggttttattttaaaacgtttcatttttagaatcttatctcttctaggaaaagtgtagtacatacatcttttttgtatgcagagtgaatttcttctccaggcttctctgacatcaatggggcaaggtcataactctataaaacagggagaagcactgagcattttcagaaaggactctatctgtcttgaccaaaagacaaaggactggtcattgcaggatccccagaaatacattttagtagcttccaagtgaattcttttgtaaatggagtttcactccattcataagttttagagcaaaaatgaagccttagtgggtctagatatctggctaacattaactccctgtgtgaccttaaactggtcgtccccagagctttatgcttttatacaattaacttgaattacagcctctccttcttgcccataagaatgataataccacctgcattactcatcttttacgcttatgtgagacacctagccacctatcagaaggtattcaaatgcaaagcattaagtttttacactttaatgtgaagtggaagaaagtcttgattcaaatgcacaatctctacctttctactgattccacatttgctgtcttttactagtgcagttaagtcccaaattagaaacataagtcgccccaacatgtgacaaatgtcctttgttgccagagaaaggacagtggggctgtgtcctcagccttagcaaccagaagattctgcaagaccaggacattctcctgccagagcctgctttagtgtccagtcctgttctccaaagagatggaaaaaaccaagtggaaaagtttcagtttattcaatataaggctccacattcaaatggcaaaactgctctgttcaggtcatatttcaagcccaacctatgtcagtccttagtaaaagcttcaaagcaataccagtcctttcccagcctggtttaccttgattagacaaacacagacacccatgtctgagtaagcactgagaccatggatgagtgctaaggagattaggtgtttggatagacacagctagggtgtgtgtatgtgtgtgtgtgtgtgtgtgtgtgtgtgtgtgtgtgtgtgtgtagagagagagagagagacagaggcaaagacagagacagtgctcattgggcagaggacagagtagctgagatagtatcatttgtttattcatttgctttttcataaaatacttagtaagcacctacttggtatgtgccgacactttaataggtactagaaagagcaagacagacagaatcacagtcttcagagaatttacagcctatggggttaattaaaccaatgattatcatagcatgtaacaaacaaaagagaacccagaatcagctgtatggaaatgcacacaggtggcagatataaatagcagcagatacacgaatcagtgcgggtccatcatataactcctagctttagtctctaaacttaggctcccactcaactcaactcctactctaactcaagatataccataccttggtttgctctttctctaagcatcgctgttctagtcttctaaggaacaggaatataaatctacatctatgtgaaactacagcacccccaagggaaaataaagaatccagtgctattctagtaattttagggtatagtacagtacaatgcaaagtataggcttttgaactaaattggcctgggttcaaatatgagccctcttacattctattaggttgaaccatataaaaatggagatattcaatcatttttttacagtttcacgtagttcatctctgtattctagaggtaaatcattttaacctaagtttcatttccttctgttgttagtttttttaatggtgctaatacccctacctttcagggttgtaaatgaaaagatgttaaaaaaaaaaatacctgacatatagtgggtgttcaataaatgttagttttcccaaagacagtcagatgcatgaatcataataagaggtatttctggtcaacactaagcttaagaatccaagaaaagatatatcaaaatgagacatctttgggtttggatagtgggggaggctgtatatacacaggtatgtatgtaggggcagggagtaaatgggaaatctctggctcttctgcttaactttgccgtgagcttaaaactgctctaaaaaacaaaatctgaccaggcctggtggctcacacttgtaatcctagcactttggggggctgaagcagaaggatccctcgagcccaggagtttgagaccagcccgggcaacatagaaagaccctatctcattttaaaaaactaaaaaataaaaaataaaataaaaaacaaaatccatttttttaaacaaaaagaaaaatgagggaaaatgaggtgttctgcttgttttatttagactctgagcacagagttcccaagatacattctgctgtggtattcacactgatctccaattaaacccttctcagtgtgtcatgagctattcattccctatagtcactctgttagaatcttggtcgtgtcccagaggcctctgttgatgtggcccaactgagctggcaagtgagaaaacatacacataaatacccatgatctcagcgattctctcccctccccaggacattccttagcagaaccaatctctctcactcggctggagcctctctgttcacagataggcctggctgggcttaatttagcaaagggcaggccccctgcaaaagccaggggtaagtctggagcccctgtaatgccccaggacaccttgtgtggagacaggagcccagccctgccgaaggagctaaaggggatgttcagaatgtttgtttttctcagctatttaggaactggagctcacgggaaccaccctttacttccttaacttctcacataaatgttttctttgggcagcagctatagaactggaaactaagtaaaaccttactttggaatataaaaactatattaatttttctacagataaattgttgcataggaaacttgctaaatatttttaaattatctgtaacacctaacataatctgacatttatccccaaattcagctttcaattctggattgaaacatactttgatctgttctctaaaaaggacaaagccagtcactggtgttttgcaaagtctgggaccatttttcctacacagaatctcacacaataaacagacaagatattagaaactaagttctaatatctagcagtcactccttccctggaagcctggctgtgtcctgaagccaggtcctatgatcaggcaactcttctgaagctctgcttccactagggacagcacttaccctgtagactctacagatgtaccatccaggatggcaggcatgagccacatgtggctactgaacccttgagatgtgactagtccaaatcgaaatgtgctgtaaggatttcagacttagcacgcacaggagttcaaagactaactacaacaaaagaatgtgacatctcattaataattttaaaatgttgatttcatgttgaaatgataatgttttaaatgtattattaacattaatttcacatatttctttttactttttttaatgtggccatgagaaaaatttaaattacatgtatggcttatatttacgttggacagcactgttctataagatgttaggaaaaagatgtatttgctttaagtactttgcattaagacatagtctgacctgaatcacagttaatcctgtggtctcatagcatcttggagagttttgtggggtgctggcatccatcaaccaacaaaataccaaaatgactctaggtaattataagtgaagcaaaaccactgggcagggatgataacaggcactgtacttaacaggagtcagcgtatcacaatgctgctcggactatgttcagacactaaactctaagtgtcatgagggcagggactccctctatcttctcaccattgtagcattgctagcacaatgcccacacacagaagataatgatatatttatcaaacaaatggatgctgttcaaaataaaaatatagctctcttgaaaaacaattctccctgcaagaacttcctcttcttactgtttcttttctcaatttttttgcttcctacttccaccaacccctcttgcagagactgctccattccagtaaaaggtgaaggttcaactggagacctccaaagtcggctgggcctagggtttgggtaggcaattgctggaagagcacagagagggaaagatttcaggcagtggtgataagaaaaggcccacctgggtcaggtgtggtggctcacgcctgtaatcccagcactttgggaggccgaggtgggcggatcacgaggtcaggagttcaagaccagcttggtcaacatggtgaaaccccgtctctactaaagatacaaaaaaattagccaggtgtggtggtgtgtgcctgtaatcccagctacttgggaggctgaggcaggagaatcgcttgaacccaggaggcagaggttgtagtgagcggagattgcaccactgcactccagcctgggcaacagggacatactccgtctcaaacaaacaaacaaacaaaaaaaccagaagaaagcactggcagtctcttaccgccatatcaatccatctacacatctcgggttacattctctgtctttccacttataaccatagatcaactatccatgctcctatctaaagccaaaccttccacttatgtattaattaagtcctattccccctacctctcaaaggcaacacctagaaggtctcccctgcttctctttatcaatatttcactttctaatggaaaattatgttggcatacgaacatgctattattcatttatctttctagaaatcccctatggacctcatacccttatcaggtatgccccattcctttgctctcctttgaaacaaaactcaaagtaattattcatcctcattgactccaattcttctcctcacattgtttcttaaacccactgcaagcaggcttttgtcttcaccactccaccagaattactttaatcaagatcactaatgacatccatgttgttaaatccaaaggtcaattcttttttgagacagagtcttgctctgttgcccaggctggagtgcagtggtgcaatctcggctcactgcaacctccgcctcctgggttcaagtgattctcttgcctcagcctcctgagtagctgggattacaggcatgcgccaccatgtccagctaattttcgtattttcagtagagaccaggtttcaccatgttggtcaggctggtctcaaactcctgacctcaagtgattggcccaccttggcctcccaaagtgctgggattacaggcgtgagccaccacgtctggcgggccaaaggtcaattcttaatcatcgtattactcaagctctcagcaggatttcaaaaggtggatcctgtcctcttcactacacacattcttcatttggcttccgggactccagactttttctcctacttcactggtttgtaccttctctatcttccttttctgattcttcctcttttctccaaattactaatgttggagctatacaggaccagtctctggtccttttctcttccacctggaaaggtctaactccaactcctttggtgatctcctatggtttcatggctttaaatatttaaatttaatatttaatgatctatttgctgataactcccaaatttatgtctctagccctactctatttcctgaactttagacttatgtattcaactgcttacttaatgctgccacataaaatgtctagcaaatagcttacacaccaaatttccaaaactgaacccctactctccaccttcaaatctgctccatccatagccttccctatctcagttatggcaactccatccttccagttgcttactccaaaaaccctggaattttccttgattcctttatttctctcccattctgtatccaatccattgacaaaatccttttagatttgctaccttcaccacttgttcccacatgcatcactattacctaagtctgatcactatcagcccctacatacattactgcagtgtcttcctaagagtcctcctggtgtctacttttgttctacagcctatttgcaatactgtaaccagatttatcatttcaacaagtcagacaggactggcatttgttagacccctcctctgctcaaaacccttcaataggttcccatgtcactctgagtaaaagctgaagtctttaaaatcatctacagggacttactacacaagccccataccctctggggcctcatcttccagcatgcttaatcttgattatgctgcatcagccacagtggctttcctgatgtttctctgcctggaatattcttcccccagttctctgtttggccaacttcgtcatctccttcaagttgctatttgaaaattattttctatggcatagccactttgaaaaatagttagacagtatctattcagaaaataggcagaaataccgactgggcatccctaatctaaaaattcaaaatccagcatgttccaaaatccaaaactttttgaggaccaacatgatacctcaggtggaaagctccatgcctgacctcatgaaaggttgcagcaaaaatgcaggcacaacacccagtttattcagcatccccaagagaaaaacataattaccttcaggctatgtgtacaaggtgtatatgaaacataaataaatttcatgtttagacttgggtcccagccccaagatatctcattatgtatatgcaaatatttcaaaatctgaacacatctgaaaatcttctggttcaagcatttcagataagagatatttaatctatatatacttattatataacctaacagttccactactgggcatttacccaaaagaaataaaacaaagacttgttacatgaatattcatagcagcttaatccataatagcctgttactgaacacaactcatacattcatcaacaaatgaatgaataaacaaattgtattatattcatacaatggaatactactcagcaataaaaatgaatgtactactgatacaaatagcatggatgaaactcaaaatcattattctaagagccagatactatagtctgtattttatgattcactttcaatgaaattctacaatagacagaactatctatcaacagaaagcagatcagtggttttctgcagccagaggtatgaaaggtttgaaacatgtggcaccagtaggacatatggaaacttttttggtgtgatggaagtatttttttatcttgattgtgtggtgtttgttatacagtggtatacatttgttaaaatttatctaactgcatacttaataaagtttatttaaacaaaacatgaaaggaaaaactaaaatgacatagcaagtggcaatgcaaactgccaagtgcaaagaatgagtaaagagcttggttggcatggagactaccagtctaggatgctttcattgcctcaggtcagcttggaaggccataaaggctgtgaaggtaaacctagaaacaaatcttcctgcactggtaactgtcatgtttatttgcttccctttccatcccatcctttcaaaaaaaaaaaagtaaaaggtagtgtggtccacaaactacagtgtggctccccatgatccccgcctcttggtgtttgtgcccttgtgtaactccttctctttgggtatgagcaggccctgcgacttacttctaaccaatagaatatggcaaaggtgaaagaatgtcactcctgtgattatattaaatttcaaggctctcttgcttgcagatttgctctagagcctctccttgctgacttgaagtggccatatggggaaagctcacatggcaaggaacactaggtgacttcaaggaaccctggacagcctctagccaacctctggcaagaagtcaaggccctcagtcctactgctacaaagaaatggattctgttgacagcccaagtgagctctgagtcagattcctcagtcaagcctctagaggagaatgcagcctggccaataccttggctgtagcctagggagaccctaagcagacaacccagctaagcggtgcctggattcctgacccacacacactgtgagataataaatgtgttggggggtgaaggagggataggggtaggggtggctgtgcatttgggtatggaagggtgttttaaatcactttctaaacacggcctctcctggccactccttaatactgcaacctgctctccactcctgtaatttttttctcaacatttgttttaggttcagggggtacatgtgcaggtttgttacatgggtaacttgcatgttgcggaggtttggtgtatgaatgaacccatcacgcaggtagtaagtatagtacccaatagttagcttttcaaccctctccccccttctaccttccactggggtaggccccagtgcttattgttcccatctttgtgtccatgtctcaaagttttgctctcacttataagtgagaacatgcagtatttggttttctgtgcctgtgttaattagcttaggataatggcctccagctgcatctcttttgctgcagaagacatgatttcattcttttaatggatgcatagtattccgtgctttatatgtaccgtatttttcctccccagtctactgttgatgtgtatctaggttgattccatgcctttgctattgtggatagtgctgcagtgaacatgtaagtgcatgtgtctttttggtagaacaatttattttcctttgggtatatatccagtaatgggattgctgggtcaaatggtagttctcttttaaattctttgagaaatcaccaaactgctttccgcagtgactgaactaatttacattctcaccaacagcgtataagcacttttctctacaaccttgccaacaccttattttttgtttttcacagtaggcattctgactggtgtgcaatggtgtctcattgtggttttgacttgcatttctctaatgattagtgatattgagcatgagaattttttcaaatatttgttggccccatgtatgtcttccgttcatgtcctttgcccattttttagttgggacaaggtctcgatctgttgcccaggagtgcagtctgatcactggagttcagtgatgcaaacacagctcactgcagccttgacctcctaggctctagcaatccttccaccactgcctcccaaagtgctggagtttcagatttgagccaccacacctttgctcatttttgaagtggggcaagacccccacttcgtaggactattacttgattgagattaaatatgtgtaaaatgcataacatggtgcctggcttatagtaaacactaaatggatttcttcttccataggatttaaatagggagcaattttttttctatcaagagctgatcagaaataaatgggaagcatttaaatgctctccttccgttgccccaagaggactttcactttccaacattctacatactttatgtataatatttattgtttattttctgtctactcatgacagactataagttctatgaggatgggaatgcctgtatgtgcttattatatgacctaacagttccactactgggtatttacccaaaagaaataaaacaaagacttatacatgaatatattgatatatactccagtcacctccaatagaatctagaacacagtaggggcttagtacatatttttaaatgaatgaagactaatgtttagtttaaactaggattgacctattcttatcctcggcagggacagagaataactaattaccacttgtcacatattgagacttcagtacctaaaaggcactattaggtcacctgtaagtctgttttcccccaaagtaaaaatcccaattccattgcccttttcacataagcctcattttctaacctttttagtttggtttaacgaatttcctatttcctctgaattctagagttccaaaccagactcagcacaagcctaacagggcaacctatacagataaggacagcccaggcacattgcacacggcaagttgcacctgttttaagagtaaaaatgaggtcaatgccaccttgtactgcaggtacctcaatgagacaatgccaccccttcctgccacaatcttggcaaaagtcactacgaaagtaaatatcattttactagagtcctttctttctctccagtgaataacacaatgtagttattcactggaaaacatcatttgcatttgaaagagttactaactaaattctaaagaatgtaccaaagccttgcttaactgtagaatgaggccacacggctgctgggataccaggtactctccctgagcctattgatggcaaatttcatcctgtgaaaaatgggaacaagacacccacttcataggactattatatggttgaaattaaatatgtgtaagatgcataacatggtgcctggcacacagtaaacacaaaacagatttcttcctctatagcatttaaatgggaagtgtttagcgtttacttgccatgtgcatgagtgaatttgggaaaagtggggggaggatatggggcaaagaaggacagaaagggcctaagagtaggaagaatttaataccagaagatgggacaagacctgggtctagaaacctcttctgcagataaagtagctgcaaattatagggaaggagtcctcaggctgctttccttataaccatttattttcctgcaccttacatcaagaacgttaggcactggttaagaccctgtccccttgcagcagtagagaaaacaggaggaaggagacgggaggtagaaatttggaagctagcagttgaaggccaactcagaaagcgtcaggtggaattccattcctaattgacatcaccatcctctaactgcagcaattctctccagcccttttatgtgctccctacagaaccaagcttccacacagctgaaggaacctgtctgctctcaccccagcttcacagaagatggcagggactggttattactaacctgcctcctagtcttctgaggctccaaatggttttgtcagcaagctgagcttccccacaatcccacagactagaaggggttggaaagaacaagccttagtacaatactgctccccacctctaagggatctgctcctctgagtcccagaagttcaccaccttcatttgatttctgctacaggaagactctgggaatccagctctggacccagcacttcctgatttttgaagtagagagttgacaaccctgttgtcatcaatacaactgtgctaggtgggtgggaaaggaaaatatcttgggctcccaaaatcactaagctaaaaggaaaactcaggatcatgctggatggaagtcaggactagattgcagctccgactcggatggacagagaagcatgtggaggctcgtatcatgaatttttgctccagaacgactggaggaataaattacaaaacctcagaggacccacaggccccctgaaggaagcagatggctcctgcaggacccaggagacacaccaaatactgtgttagtatttacttatagaaatgcaaaatggtctggaaagtctcagccatagaatcaaacaagtagaagaaagaaattcagagcttgaacacaaagtcttcaatttgacccaatccaacaaagacaaagaaaaacaaataagaaaatatgaacaaagcctccaaaaactctgggattatgttaaatgaccaaacctaagaataattggcattgctgaggaagaagagaaatctaaaagtttgaaaaacatatttgggggaataattgaggaaaatttccccaaccttgctagagacctaaacaaatacaagaagcacaaagaacacctgggaaatttattgcaaagagatcgtcacctaggcacattgtcatcaggttatctaaagttaagacaaaagaaagaatcttaagagctgtgagacaaaagaacccagtaacctatgaaggaaaacctgtcagattaacagcagatttctcagcaggaatcctacaagccagaagggattgggcccctatcttcagcatcctaaaacaaaacaattattagctgagaattttgtatccagtgaaactaagcttcatatacgaagagaagatacagtatttttcagacaaacaaatgctgagagaatttgccactaccatgccagcgctacaagaattgctaaaagaagcttcaaatcttgaaacaaaacctggaaacacatcaaaacagaacctctttaaaatataaatctcacaggacctataaaacaaaaatacaattcaaaaaaacaaaaacaaaacccaaaaaaccaaggtatacaggcaacaaaaagcacaatgaacggaatggtacctcacatcccaatactaacattgaatgtaaatggccgaaatgcgccacttaaaagatacggaattgcagaatggataagaattaaccgaccaactatctgctgcctttaagagactcacctaacacataagagacttatctgacacataaggactcacataaacttaaggtaaaggggtggaaaaagacatttcatgcaaatggacaccaaaagcaaaagcaagcagaagtaactattgtttttttggtttttttgagatggagtttcactcttgtagtccaggctggagtgcaatggcgcgatcttggctcactgcaacctccacctcccaggttcaagcaattctcctgtgtcagcttcccaagtagctggaactacaggtgtgcaccaccatgcccagctaatttttgtatttttagtacagataggtttagtacaggcaggggtgatctgcctgccttggcctcccaaagtgctaggattacaggcataagccaccgtgcctggcccagcagtagttattcttatatcagacaaaacaaactttaaagaaattgcagttaaaaaagacaaagagcggcattatataatgataaaaagccttgtccaacaggaaaatatcacaatcctaaacatatatgcacctaacactggagctcccaaatttataaaaccatcactaatagacctaagaaatgagatagacagtaacacaataatagtgggggacttcaatatgtcactgacagcactagacaggccaatgagacagaaagtcaacaaagaaacaatggatttaaactataccctggaacacatggacttaagacatatatacagaacattccatccaacaactgcagaatatacattctattcaacagtgcctggaactttctccaagatagaccacatggtaggccacaaaacaagccgcaataaatttaagaaaattgaaattatatcaagcactctctcagaccacagtggaataaaactggaaatcaactccaaaaggagctttcaaaaccatgcaaatacatggaaattaacctgctcctgaatgatcatgaaatcgagatggaaattaaaaaaatcttcaaattgaacaaaaatagtgatacaacctatcaaaacttctggaatacagcaaagtcagtgctaaaaggaaagttcatattcctaaacacctacatcaaaaagtctaaaagagcacaaacagacaatcaaaggtcacacttcaaggaactagagaaacaagaacaaaccaaacccaaaccagcagaagaaaggaaataaccaagatcagagcagaactaaatgaaactgaaacaaacaaacaaaaaatacaaaagataaatgaaatgaaaacctggttctttgaaaagataaataaagctgccgggcgtggtggctcacgcctgtaatcccagcactttgggaggccaaggtgggtggatcacaaggtcaggagatcaagaccattctggctaacatggtgaagccccgtctctactaaaaatacaaaaaaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttataggtgggaattgaacaatgagaacacatggacacaggagggggaacatcacactctagggactgttgtggggtggggggaggggggagggatagcattaggagatatacctaatgctaaatgacgagttaatgggtgcagcacaccagcatggcacatgtatacatatgtagctaacctgcacgttgtgcacatgtaccctaaaacttaaagtataataataataaaataaaataaataaaaaataaaaaataaaaataaaaatacaaaaaattagccggacgccatggtgggcacctgtagtcccagctactccggaggctgaggcaggagaatggcatgaacccgggaggcggagcttgtagtgagccgagatcgcaccactgcactccagcctaggcgacagagcaagactccatctcaaaaaaaaaaaaaaaaaaaaaaaaaaaacctagaagagatggataaattcctggaaagatacaaccctcctagcttaaatcaggaagaattagatactctgaacagaccaataacaagcaacaagattgaaatggtaatgtaaacattaccaacaaaaaaagtccaggaccggatggattcacagcagaatgtaaccaggcattcaaagaattggtaccaatcctattgacactatttcataggattgagaaagagggaaccctccctaaatcattctatgaagccagcatcaccctaataccaaaaccagaaaaggacataaccaaaaaagaaaactgcagaccaatatccttgatgaacatcgatactaaaatccttaacaaaatactagctaaccgaatccaacaacatatcaaaaatataatccaccgtgatcaagtgggtttcataccagggatgcagggaggtttaacatacgcaagtcaataaatgtggtacaccacataaacaaaattaaaaacaaaaatcaccatgatcatctcaatagatgcagaataagcatttgacaaaatccagcatccccttatgattaaaactctcagcaaaatcagcatacaagggacatatctcaatgtaataaaagccatctatgacaaacccacagccaacgtaataatgactgggggaaaagttaaaagcatttcctctgagaactgaaacaagacaaggatgcccactcacaccactcctcttcaacatagttctggaagtcctagccagagcaagacaagagaaagaaataaaggggatccaaattgttatagaggaagtcaaactgtcactatttgctgatgatattattgtttacttagaaaatcctagagtcctccagaaagctcctagaactcataaaacaattcagcaaaatttctggatacaaaattaatgcatgcgaatcagtagctcttctatacaccaacagcgaccaagctgagaatcaaatcaagaactcaaccccttttacaacagctgcaaaaaataaaataaaataaaatacttaggaatatacctaaccaaggaggtgaaagacctctacaaggaaaactacaaaacactgctgaaggaaatcatagacgacacaaatgaatggaaacacatcccatgctcatggatgggtagaatcaatattgtgaaaatgaccatactgccaaaagcaatctacaaatttaacacaattcccatcaaaataccgccatcattctttacagaattagaaaaaacaattctaaaactcatatggaaccaaaaaggagcccgcatagccaaagcaagactaagcaaaaagaataaatctataggcatcacattacctgatttcaaactatactataaggccatagtcaccaaaacagcatgatactggcataaaaataggcacagagaccaatggaacagaatagataacccataaataaactcaaatacttacagccaactgatcttcgacaaagcaaacaaaaacataaagtggggaaaggacacccttttcaacaaatggtgctgggataattggctagccacatgtaagagaactaaactggatcctcatctctcaccttacacagaaatcagctcaagatggattaaggatttaaatctaagttctgaaactataaaaattctagaaggtatcatcgaaaaaacccttatagacattggcttaggcaaggatttcatgaccaagaacccaaaagcaaatgcaataaaaacaaagacaaacagctgggacttaattaaactaaagagcttttgcacggcaaaaggaacagtcagcagagtaaacagacaacccacagagtgggagaaaatcttcacagtctgtacatctgacaaaggactaacatccagaatctacaacaagctcaaacaaatcagcaagaaaaaacaaacaatcccatcataaagtgggctaaggacatgaatagacagttctcaaaagaagatatacaaatggccaacaaacatatgaaaaaaggctcaacatcgctaataatcagggaaatgcaaatcaaaaccacaatgtgataccaccttactcctgcaagaatggccataatcaaaaaaataaaaaaatagtagatatggatgtggatgcagtgaacagggaacacttctacactgcttgtgggaatgtaaactagtacagccactatggaaaacaatgtggagattccttaaaaaactaaaagtagaactaccatttgatccagcaatcccactacagggtatctacctagaggaaaagaagtcattatacaaaaaagatacttgaacacgcatacgtatagcagcacagttcacaactgcaaaaacgtggaaccaacccaagtgcccaccaatcaatgagtggataaagtaactgtggtgtgtatacacacacatatatatatatatgatggatatatatatatatatatatgatagaatactactcagccaataaaaggaataaattaacgcattcacaatgatctggatgagattggagactatcattctaagtgaagtaaggcaggaaaggaaaaccaaacattgtatgttctcactcataagtgggagctaagctataaggatacaaaggcataagaatgacacagtggactttggggactcaaggggaaagggtgggaagtgggtgagggataaaagatcacaaatagggtgcagtatatactgcttgggtgatgggtgcaccaaaatctcacaaatcaccactaaagaaattactcatgtaaccaaacaccatctgttccccaataacctatggaaatgaaaatacaaaaaataaaaggaaaactcaagctggaaactgtttagggcaaacctgcctcccattctattcaaagttatctctctgctcactgagataaatgcatatctgattgcctcctttggaaaggctaattagaaactcaaaagaatgcaaccttttgtctctcttctgtgacctagaagccgcctcccccactgcaagttttcctgcctttgcttcaagttgtcccgcctttccagaccgaaccaatgtacttcttacatacattgattgatgtctcatgtctccctagaatgtacaaaaccaagctgtgccccaaacaccttggtcacatgtcataaagacttcctgaggctatgccaggggcacgtgtcctcaaccttggcaaaataaactttctaaatttactgagacctgtctcaaattttcggagttcacagtgggcaagactagatttacttttgtgttgagcagatactgagcttgactgataagaatctggagtgtgaggtctcacggagtaactctgatagaggaagctacctgtgtggtctcagggagaagatctgagacttaccaagaaaaagtgacctgaaagaactggctgacttcaggaccttgaacagtgcctagaccctctttctgcagctccagatcatagccatcatgctggcagcctccctgccgctcatccaggcaccttaaagaagggcttcctcttcccaagcctctgggtgggctttctaaagccctgtgtgcatgaagaggtggcttgtagccctttgcagcagcagggcttacatgaggctgggatatgaaaagctggcattacaatgcagcttgtgccttgcattcactccccacttcatcaagccaagtttctaaataacagggatagtaactgcccactgtggcccaatgtcacttctaaagttgcttggcaaaaagccacatgactattacttagctctccacagaacggcatgtaccaagtcggatcactgctgtcggtgtgtgggtggattagctgctattgaacatgatagggcgggcccctttccagtttgcaccagccccgctctgtgcctactccatgtatcatagagcctcctctctctgtgcagttgaacttgatcagatgagatggcaagagccagagcagggagcaaggcaaaagagaaaaatatgttcacggtgacttttgaaaacatatggatgaaactcctgaggaggctgaggaactaaaccttttcttttggcagtaggcacagagtgcagattcatctctctgtaattactctagctcctgctgtgtgagttctattttagcccagtaatgcaaaaagaaagaaaaactaagttctgacaagcacttacatttcttgaatttttgttgaaggtcccagaggtcattgtaagcagcctgaacaggtagttagggctcctggattctagtctcagcttggctactaatttaccgtgtgacgttaggcaaattactattctgagctttagtcatcttatctttaaaatgaagggtttattctttagaggaagctgagtgaatggcatatgggaacactctgtactatttttataactttgctataagtctaaaattatttttaaataaatggttttcttaaaaagtgaaaggattatgtagattatcttcaagatcctctctacctctgaataatgattttatgttcttacttatcttccttcaggtgaaagtaagtctctttccagctatccaaacatataacagagtggaatttttcctcactccttctgccccaggcaagatgttgatcagccccaacacaaacctgttttctgctttaaacatatcctatacctagggcaaaatttaaattatctaaaacacatttaaaaacaccccatccatacccactttgttctttcaaacaagtaaattcacccagcagggaaaagctgttgctggcagtccatgcttacagaatctcagccttgccctagcaacgaggctaattataactccggctacctggtaaccgcactagatttccctgcattggctggcagttctaaagccatctcagctctgcctgccacctcccatcctgagaagctgtcagagaagctgagaaactatgagtctcttttaagcaactatctaagctgtggtgagaacacccatgtatcatagagcttcctttctctgcgcccagagaaaggctgcccagaatcacgggacttcagaactgggagggatgtgtgcgtcaatcctggtccagcccactcatttaaacacaaagaaccagaagcccagaaaaagtgacttgccttagcctggccttcctcttgattcctttccctcaattctcccatcctgatcaatcatcaagtcctacaaatattttacctcttaaatattttaaagatgagttgcctcccctctattcctactgccacagccctcattcgggccttcatcttctttggcttggcaagtctgttctcactcacttcctgccttgactctcttgaatccacctttcccatgcatcagagggatctagcaggttccctgcagcttaaagcccatcagtggtgccttgtcttcctcaggataaagtctacaatctttaaaatggcacaaaagactgtgtccgtcatatcagtctcattcttcgcctagtacttaaatccaccaacactaaaccacttctaattctgtgcaagcaccctatggtttcttgcctcaaggcttttgcttgtgacaaaaactctgtccttccacttcatcatccattgactgattagtgcttattcccctttgaagacgaagttcaggggtcatcacgaataatcctttgcagattttctttccatccactctattcatttgggatagaagtgccccctttgagtttccttacactttgtacacagctctgttactgccttttactatactctagcacctgtggtttgctcatctttgaagtcccaacttctagtacttggaacatagcaggtacctaattaatgtttattaatgaatgaatggataagtccaaagctttccatgatttctcccctgcagcctcatcttaccaccaccacaagccctccaaaccacatgatctagccatacagaatgattccagtgtgccaagtgcacattgcttttgtacacctctgcttttgtatattgtttcttctgtttgaaatgccttttcccaccaggcgcggtggctcacacgtataatcccagcactttgggaggccgaggtgggtggattacctgaggtaaggagtttgagaccaccctggccagcatggcgaaaccccatctctactaaaaatacaaaaattagccgggcatggtgacacacgcctgtaatcccagctacttgggaggctaaggcaggagaatcgcttgagcccaggagacggaggttgcagtgagccgagatcatgccactgcactccagcctggctgacagagcaagactctgtctcaaagaaaaaaaaaaagaatttctggattttccaggcatggtggctcatgcctgtaatctcagcactttgggaggccgaagtgggtggatcacgaggtcaagagattgagaccagcctggctaacgtggtgaaaacccgtctctactaaaaatatgaaaaattagcgtatgtttcacagcatctgtaatcccagctactcaggaggctggggcaggagaatcgcttgaacctgggaggtggagattgcagcaagccaagatggcgccactgcactccagcctgggccacaaagtgagactccatctcaaaaaaaaaaaaaaaaaaagaagaaaaaagaaatgccttttcccatttcttgttatgttactaccttttaggattcaatgcaaacttcaaacacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcctcccaccctcattcacttctgtcaggctagactctctctccttttcattggcttgtcttagctattaataagtctcggctgggcgcagtgggtcacacctgtaatccgagcactttgggaggccgaggtgggtggatcaggaggtcaggagattgagaccatcctggctaacacggtgaaaccccgtctttactaaaaatgcaaaaaaaaaaaatagctgggcgtggtggtgggcgcctgtagtcccagctactcaggaggctgaggcaggagaatggcatgaacccaggaaccggagcttgcagtgagccgagattgtgccactgcactccagcctgggagacagagcgagactccatctcaaaaaaaaaaaaaaataaagtctctgaccaggggcgctggctcacatcttaatcccaacactttgggaggccgaggtgggcggaacacctgagctcaggagttcgaaaccagcctgtccaagatggcgaaaccccatctctactaaaaatacaaaaattagctggcatgttacttggcccttgtaatcccagatgcttggcaggctgagggatgagaatcacttgaacccgggcggcagaggtggcagtgagctgagattgtgcctctgcacttcagcctgcgtgacagagtgagactctgtctcaaacaaaaaaaccaaaaaagaaaaaaattaaaaaagcaaaatgaaatcttttgtgctacacagaaacattggccactcatggggtaaaaatctcagggccaagccttgctttatagaaacgtataagcaagaaaagtgtagaagtgtttatgtcttggtttcaaggtgactgcatagctaagacaagttgacttaaaggagatcaagactggagatgacaagagtgaaaccagggaaacaacatcttcaaataagtaaacaaggctgccagtgacatccctcagtcctgattaagcctatttgatttcaccagtttttaacccatcatgtgtttgcctttcttctccccagtccctggccccacctcttctgccacaaacgtcagcatggtggtatcagccggccctttgtccagcgagaaggcagagatgaacattctggaaatcaatgagaaattgcgcccccagctggcagagaagaaacagcagttcagaaacctcaaagagaaatgttttctaactcaactgtccggcttcctggccaaccagcagaacaaatacagtaagatctataggctcaccatcacgaaagtgatgaacgacgtcctgtcttctctctgaggaactaagtgctctctccatcaaaaataatgtcatcctccccatacttctaggaaaacagaaatgggtattttaacattttgtcaaagttggaagacagaggtaccaaagtatttagcaactttccatgtttgcaatcaggtgggggtgggactagagttaaactgccatttattgatttctgacacaggcacagaatgacctgttttctccaagaggctcaatcgtgttttcaagaatcctctctaccatataagatcctgcagacaaataacatctagtctgttgttctaaatgtctgagactagtgaacttttattcagttcaagtttctgttgaggcccaacaggcaaagctctgttctagtgactctgagggaaacttggtgatagtagccagtacctgctctgaggggcttcaagaggagtctactcctaatagaacctgtgctgtctataaatgacagcatcaagagcagggagtaggggccatgcatggtggctcactcctgtaatcccagcactttgggaggctgaggcgggcagatcatgaggtcaggagtttgagaccagcctgggcaacatggagaaaccccatctccactaaaaatacaaaaagtagatgggcgtggtggcaggtgactgtaatcacccctgctcaggaggctgaggcaggagaatcctttgaacccaggaggctgaggttgcagtgagccaaggttttgccattgcactccagcctgggcgacagggcaagactggtaaaaataataataataataataatgatgataaataaaaataagaataaaaagcagagagtagcttggtgagagtgaagtcctgcttcctggggcacagagtcttgttgctaaagaggaagaaagttcgcacccgagaatgtgtggagatagcagtgcagtgtacagagcagggaccgtgggcctgtctcctgggctccatccaagttgcttgtcttgtctgtccctcagttacctcacctgttcagagggtactacaataatacctacctctgtaaattgctgcagtgaattacatgagctgtttcttgtcagtctcctagaacatttattggcacagagtaaacactatctattagttcttcattctgctgtttctaaattaacacaaactttattagcatttgggcatatttccttcatggccttatggtcttatgtgtcacattttatgcttcagatatgattcttaaaatcataactgaagatatgatttaaaaatcaaagatttaaaaaatctttcgcatacttgtccttgaaattcccagtaaaagggaaaccatcagtcccatagtcctaggggccttcccgactgtacaagaaatcactacttcatgccccagtgcagtgttttagaggagaggctgcaaagcttgggaaagtggccccgcattcagagtcagacctcagggactgtgaattctgactccacttcgttgtggttgaatcatcttgtcaacttccttgatgtgtccttgaggttctctttcttcgtctttaaattttggaggatcagatgccagaaagtcaggagactgaagagtaaagatgtggaaatccctgtctagaccctggtactggggagagttttgtccttgggatggacctggctcctgccctgtaggcagtgaccacagcagcatgtccagccttccactgagacaggcgtgtctgtcttttctcagagtatgaagagtgtaaagacctcataaaatttatgctgaggaatgagcgacagttcaaggaggagaagcttgcagagcagctgaagcaagctgaggagctcaggtgaggggaccccatgggggcaggcaggggggcaggtgtgtaaatctctgaagtacagcagctcggtggggagacgtaagagctaagctgggccaggggaagggcaggaattgccatggcaggctcgctacacacaaatatttatcaaacagagaagaaggataataaaaatgtatgggttgcagttgtttctcagagccttgttttctctttttcaaacaagtaattgttgatgtgaaatttacataacacaaaattaaccaaaggagtgtgaaccacacagcagcattcagtatactcaaaatggtgtgccatcaccaccccacttacccttagtgacaatcacctcctgactgactgcggcttctcattctttcactcaatcaatgttgccttctcgaccctgtcattcttttcttctttcgtcttttcaattcgccccatctgcccctggcctcatttctgtacatggctttgtatctagtggccgcaagatgcactatgtgtattttcacatggaaatgtccatggccagagtgaggaactgaaaggatgtctttttgaaatggaattaggaaaacacctacttttgtttacagaagggaaagatgaatggaacatcatcgaggatcttgcaagagccctctctgatacagaggaagcctgtaaaccattttctattctttctcttggccacagacattcctttaaacatgtgctgaccttctgcttcgaggtctccttgaggacactgtttcagaaatctctgttgcaatatttgagcggatcactcaaccctttccactcttaatttttctctaccatctcaccttaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccaggtaaggtggccataggccctgttgacccaaaaccccaggcttatgagaggctccagacctccatactttcacaatgacagttgtatcaatggtgtttttttccactaagcttatgtggccatgacatgacaaggacttcttgggtaagaacggagatgggaaacccatggggttggaggtcacattattgcaagtgtccctcctcccttgatggaaggtggtctttggagcaagaggcagcatctatctagttttaaaggacaggaaggaggctgcgatgggagcaggcttgttagagtgaaaagagctctggactaagaatgaaggttcccaggctgtcttttcggcaatgttcttagttactgtcagagagtgaatgacttgtccttcctgagtttgtctctctccgtggcagacaaattgtctcttgcaagggtctgaagcattcaaatgtgggaacacttacaactgctttccaaaatgagatgaaggccctcgccgtgtgatgttggagaaggcactttatgtgggggcgttttgtggtaggaagtgcttcagactggagcactccccatggatagaatgtccctgaagaacacagcagaagccacttggaggcttgaaatcttctgatgcatagaggactgtgggacaagtttgtctgcttctaagagaaagaattaggtttgaaatgcaaaccgtgacaggacaccaagcctgtgcctgggaatcagatctggcaggatgggggagacagctgccaacgtccagagagaggctgcacaagcctccagtgatatgggaagcgaaaggtcttttcaatatttggccacatgttgatggtggccctccagatcagaaatgcattgcctgatggatcaggaaaccatgccagggcattctgttaaagataaaacatgagagttttcagttgaacggtgacccatgcctagatgttcatgtctctgttgcacattgggctgactgtgcttgcagactgtgaagtgggaaatatctgaacgaacacttctgtatttacagaaaatgacaacgatgacaatgaagatgttcaagttgaggtggctgagaaagtgcagaaatcgtctgcccccaggtaacactgaatactcaggaacaattaatggatggtaacatatgaggaatatctaggaggcacaccctctctggcatctatgatgggccaaaaacccgcattcgcttggccacagtatgtgaaattgaacccagcttagacacagggtgcggcagctgtcatgtttctctatgtgtgccgagtgtcatgtctgcaccgtacagggatagctgagtcttcatcctcctcagctcctatctgtccagtgcaatgaacagcagctgctctcttcctctctggttcccatggcagccatgctctgttgcagagagaagaggattacctgttccctcttaatgggaacctccattttgctttctgggaccactctcttaatgccgcctgtcaaaaccagctaggactccctggggtccaatccctctgtgtttaatcttctgtcatctctgtcccacctggctcatcagggagatgcagaaggctgaagaaaaggaagtccctgaggactcactggaggaatgtgccatcacttattcaaatagccatggcccttatgactccaaccagccacataggaaaaccaaaatcacatttgaggaagacaaagtcgactcaactctcattggctcatcctctcatgttgaacgggaagatgctgtacacattattccaggtagcctctgttttccttgtgtctcatacctctctctaggctgaggaagataaactctgaagacaggctctataaacacaaattcatttgaataaaaaactgtgatgggtttctaaacagatatcagggagttttttgtccttctcagctaatgtcatgcctttgtctgccagtccccagtatcaagttactcaaccccaggcaagtgtgacaatctcatagtcacctgagtgcaggaggtgcacaggcagtatctgtcaggcctcctagcttcgattcagtatctcttgtcatctgtgattaagtcatctgtccctgaacaatgtccatggagtttctatgcctgtttaaggaagctggcagccttgcctttgtttttggaaatatcgttccccaggcttcactgctctcagctttcatctggatctcctttaagtcagcttgcttagctgcacagtcaccctgaaatcaggacggaaacttttcttctttactttggtgatatatttccataaagcaaggctggaccctggttctccaccctgtcaatgcaatggctgatccaatgtttctttgtagcatcgtggattttttttttttttttttttttttgcgatggagtcttgctctgtcacccaggctggagtacagtggcaccatcttggcttggtgcaacctctgcctcccagattcaagtgattctcctgcctcagtctcctgagttgctaggaccacaggtgcacaacatcacatctggctaatttttgtatttttagtagagacagggtttccccatattggccagggtagtcctgaactcatgacctcaaatgattcacctgtcttggcctcccaaatcacagattctttttaaagcaagagttgttcaaatttatctatcagtcgtgtttcatgtatagatgcctctaaacatttaatgtccatgttacctggtgatataagtccgtatcgcagcaacactcttagaaaattgtttgaccaatttttggagatttttttggggaaaaaattttgtttaactttgactcaggcagggaatatggcattatggtctacacgtagagggagattttggcctgtgggtctggaaagcagggtcatctaattctcaccaaagttaatctaggacaccctagaatattcctgtcagaatccttattcttgcactgagaatagttatgtccttggctatgactggacagtgatttgttcatatgtgaagtatgaattgcttaatgtgacctgcttctctgaatttatttacagaaaatgaaagtgatgatgaggaagaggaagaaaaagggccagtgtctcccaggtaatgttgtggaattgttggctgttaattcagtagtgacatctggagattgtagatttagggaaaatgaggaagtgatgaatagaactatttcttccattcacccagctacaaattgtgctgatttacaatgttgtatgttatttgtggcacttgtattggttttaatttcatagtcctctcaagataggaacttgccatcagatgagccaggtgaactagccaaacagggttttcttgttgatcttttcaaaaaaccagccctggattcattgattttttgaagggttttttgcgtctctatctcctttagttctgctctgatcttagttacttcttgtcttctgctagcttttgaatttgtttgctttgcttctctagttattttaattgtgatgttagggtgtcaattttagatcttttctgctttctcttgtgggcatttagtgctataattttccctctacacattgctttaaatgtgtcccagagattctggtatgttttgtctttgttctcattggtttcaaagaacgtctttatttctgccttcattttgttattttcccagtagtcgttcaggagcaggttgttcagtttccatgtagttgtgcggttttgagtgagtttcttaatcctgagttctaatttgattgcactgtggtctgacagtttgttgtgatttccattcttttacatttgctgacaagtgctttacctccaactatgtggtcaattttggaataagtgtgatgtggtgctgagaagaatgtatattctgttgatttggggtggagagttctgtagatgtcttttaggtctgcttggtggagagctgagttcaagtcctggatatccttgttaagcttctgtctcattgatctgtctaatattgacagtggggtgttaaagtctcccatgatgattgtgtggagtctaaatctctttgtaggtctctcaggacttgctttatgaatctgggtgctcctgtatagggtgcatatatatttaggatagttaactcttcctgttgaattgatccctttaccattatgtagtggccttctttgtctcttttgatctttgttggtttaaagtctgttttatcagagactaggattgcaacacctgcctttttttgttttccatttgcttggtagatcttcctccatccctttattttgagcctttgtgtgtctctgcatgtgagatgggtttcctgaatacagcacactgatgggtcttgactctttatccaatttgccattctgtgttttttaactggggcatttagcccatttacatttaaggttaatattgttatgtgtgaatttgatcctgtcgttatgatgttagctggttatttcacccgttagttgatgcagtttcttcctagcgtcaatggtctttagagtttggcatgtttttgcagtggctggtaccggttgttcctttccatgtttagtgcttcctttaggagctcttgtaaggcaggcctggtggtgacaaaatctgtcagcatttgcttctctgtaaaggatttatttctccttcacttatgaagctttgtttggctggatatgaaattcttggttgaaaattcttttctttaagaatgttgaagatgctggagaggatgtggagaaataggaacacttttacactgttggtgggactgtaaactagttcaacgattgtggaaggcagtgtggcaattcctcaaggatctagaactagaaataccatttgacccagccatcccattactgggtgtatacccaaaggattataaatcatgctgctgtaaagacacatgcacacatatgtttattgcggcactattcacaatagcaaagacttggaaccaagccaaatatccagcaatgatagactggattaagaaaatgtggcacatatacaccatggaatactatgcagctataaaaaatgatgagttcatgtcctttgtagggacatggatgaagctggaaaccatcattctcagcaaactattgcaaggacaaaaaaccaaataccgcatgttcttactcacaggtgggaattgaacaatgagaacacatggacacagaaaggggaacatcacacactggggcctgttgtagggtgtggggagggaggaggggtagcattaggagatatacctaatgttaaatgatgagttaatgggtgaagcacaccaatgtggacatgtatacatatgtaactaacctgcacgttgtgcacatgtaccctaagacttaaagtattaaaaaaaatatatatatatatacatacacacaaaaaataataaaggaaaactatacatatggaaaaaaaaaagaatgttgaatattgctcccactctcttctggcttgtagggtttgtgccaagagatctgctgctagtctgatgggtttccctttgtgggtaatctgacctttctctctggctgcccttagcattttttccttcatttcaaccttggtgaatctgacaattacgtgttttggggttgctcttctcgaggagtatctttatggtgttctctgtgtttcctgaatttgaatgttggccttccttgctaggttggggaagtcctcctggataatatcctgaagaatgtttcccagcttggttccattctccccgtcactttcagtacaccaatcaaacgtagatttggtctttccacatagtcccatatttattggaggcttgttcatttctttttactcttttttctctaaacttctcttctcgcttcatttcactaatttgatcttgaatcactgataccgtttcttgcacttgatcgaattggctactgaagcttgtgcatgcatcacgtagttctcgtgccatggttttcagctccatcaggtcatttaaggtcttctctacactgttcattctggttagccattcgtctaatcttttttcaaggtttttagcttccttgcgatgagttcgcacatcctcctttagctcagagaagtttgttattaccgactttctgaagcctacttctgtcagctcatcaaagtcattctccatcctgctttgttccattgctggcgaggagctgcgatcctttggaggagaagggatgtcaggtttttggaattttcagcttttgtgctctggtttctccccacctttgtggttttatctacccttggtctttgatgatggcgacctacagatggggttttggggtggatgtcttttttgttgatgttgatgctattcctttctctgtgttagttttccttgtaacagtcaggtccctcagcttcaggtctgttggagtttgctggaagtccactccagaccctcaaacagggatttcttggtgttgcctattctctcccatgtgtctaaatccagggagaggtgtatatatgctttcttcctatttgttggtagtatgttggctagtatttttgcaagaaaagaaattgaaaaagtaaatatattatatcaaaatattgggaaaatggggcccttaatacacaagatctgtgtctgcactgcgtcaagaactctcttcacttgaatgctgcatgtaaaattcaacccaatttatgcaaagtagttgaagccctgtgtcagttctctgtgctgcaagacatgatggtagtttacagggagagtctgggtgccctgagttggctcatctgtggcaaatgtactgagcacacgctgcccatttttgctctgtccccagagcagtcaccctccaccctgtatttagaaggatagttttatttctcttgaaggaaaaatgcctttggtttctgtgaccactccattctgtctcccatcagatcatctgggaggttttgttgtctaatgtctgttggttaaatcttctatcatccctgtcctgcctggctcatcaggaatctgcaggagtctgaagaggaggaagtcccccaggagtcctgggatgaaggttattcgactccctcaattcctcctgaaatgttggcctcgtacaagtcttacagcagcacatttcactcattagaggaacagcaagtctgcatggctgttgacataggcagtgagtactccattgtgaaggtgataaagctccagttcatggcccaggtagaccccataatctttgggccttgtgccccttgttgggctgagatttgccatcactgtgggctgaacctatatatcaatgtagatttcaatcactctggagtcgagtctgaagcacaggcatggggtgggtcagtgagctttgctctcttcctagtctcaggccatgcccgtgccaacctggactgactgtcacgacattgaactcaaggcaggtgtggcaaactcacaccaaactatgtagcacatgcccaggagttgtctgtcagatcagctcatctgaattaaatgtctcttgccagctacaaaattccttatgagttttgttcccaaagcatgtctgtgtggttctttacctgcccaaggccagtgtcacccttgtctacctctcagtgaaagatgtgacccaggtttcactgaatttattcccattttctgtgtcttctaagttcgcttgttttagctcatctgtccgtcatgttcctggtatgttttctagataaatggctgacttttcacccacaaaagccataatagctgatgctactgtgtagaaccaagttacattttgactcaagagctggttcattgcaccccctcatcaaatctctgtgtccacaatctcataaactatcaaattctgggtatttgatgagagaaagcttaatattgaagtatctctcctatgaggtgttagaactatttgcctacaatttattggggaaaaaaatcgcgcatttgtgtacataaacctaggacagagcacatagggaagataacattccaacacaggggaattttgcccaaggctcatgaaagaacccaagccagttttctcaagacttgacctcaggcctactggaatatttctctcaaagtctcctgttctcacactgacaagactgatgtccctgtgttaggattggacagaggaatgtttctgtgtgcaaggaaggactgcttaatgtaagagggcccatctgaatttatttgcaggacatcggtgggatcaagtgaaaaaggaggaccaagaggcaacaggtcccaggtgagtctgagaaattgtggacagttaatttgatgttgacacctggagatgccaagtccagggaaaacagtacatgctgaaaataatgattttgtcttgtcagacaagtctgaattatgcctactacattgctttttggttctcattagagtaaatgtttaggtttccatttcttcctacccttatcatttactaacctagtgaaagttgaccatacctcaaaagctgtattctcatggtaactgcagggaaacttgagcacattttacgcaaaattattgaggacatgcttttcatgatcactgttcactgtgtgtcctgagagcacaaatacagagtgtcctttgactccctcatcagtgtgtcacctgaccaattcactcagctcgctctgtttgtgtgtgtgtgtgtgtgtgtgtctgtgtctgtgtgtgtgtgtgtgtgtctttctctttcatccttttctacctggccctagtctatcccaacataaaggcaataatttgttacctcattaatggatctgtcctttttcttttcaaactcttccttatgttagccatgaaatctagctggggctgtgtggtttctgattccccctggcttattctttactttttcccacttttccaggctcagcagggagctgctggatgagaaagggcctgaagtcttgcaggactcactgtatagatgttattcaactccttcaggttgtcttgaactgactgactcatgccagccctacagaagtgccttttacgtattggagcaacagcgtgttggcttggctgttgacatggatggtgagtacctttctatgaaggtgataaggatccactgagtcttctggttagggtcatattcctactgcaagtggccgttactgagctgagagatgtcattgccacagggaggacctataggcacatgtacgttgaatgaaactctagttccacttggaagaccagacaagggatgggtcagtgagcaaggctctcttcctagtctcaggccatgcctgtggcgccctaatcctactctcatgacattggacctgggcagatgtgacaaattcacacaactctgattttgtctcaattttgtagatcttgtagatttcatccttcactctaatttcagcgtctaaaatcctcgctaccatgaacaatctgagtatttgatgagacagggctgaatagtgcagtttttctcctagcaaccatttggggacatttgctttaaatcgattggaaaaatatggcataaccatttgcacaaacttgggacaaatgatattgggataacggtctaccagaatagggaattttacccacagtttctgggacaaaaaccaaggaatctctatggagatcagccttcaggcctcctgaagaatatctctcacagtgtcctattctcatgctgaggagcctgaagtccctgtgtgaggattagacagtggattgttatgtgtgtaggagaaacagcttaatatgactgtccatgtctgaacttattgcagaaattgaaaagtaccaagaagtggaagaagaccaagacccatcatgccccaggtaactttgagcaattatggatgcttaattctgtgttgacacctggagatgccaggtccagggaaaacaagagtgtgttcaatttcatgttttcaacggaggttgaattactcctactgccattgctgttggttttcattgcagtagatgtttaggtttccatttcttcctccccttatcatttactaacttactataggttgaccatacctcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaattcgctgagctcactttctcctctctctctctctccctctccctgtctttctctttcattcttttccacctgaccctggtctatcccaacctaaaggcaataattcattacctcattaatggatctgtcctttttctttttaaacagttccttatgttagccatgaaatctagctggggctgtgtggtttctgattccccctggcttattctttactttttcctacttttccaggctcagcagggagctgctggatgagaaagagcctgaagtcttgcaggactcactgggtagatggtattcgactccttcaggttatcttgaactgcctgacttaggccagccctacagcagtgctgtttactcattggaggaacagtaccttggcttggctcttgacttggacagtgagtaccttactatgaaggtgataagcctccacctggtcttccagataggggtgatattcctgttccaagtggcccttactgacctgagagatgtcattgccacaggcaggacctatgggcgcatataggttgtaatgaaactgtagtctcagttggaagcctagacatgaaatgggtcagtgagcaaggctctattcctagtctccagccatgcctgtggcaacctgagcccgctctcagcacattggacccaggcagatgtaaaaaattcacagaagtatgatttggactcaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatggggatatttcacccttggttctgagatgcaaaccaaagaatatcatgaccagctttcaggcctcctgaagtatatctgtcacattgtcctgttctcatgctgaggagcctgagatccctgtgtggggattagacagtggactgttatgggtgtaggtgaattggcttattttgtctgtccctgtctgaatgtattgcaggaattaaaaaggaccaagaagaggaagaagaccaaggcccaccatgccccaggtaactgagcaattgtgaacatctacttctgtgttgacatctggagactcctggttcagggaaaacagagcgggctgacattatcgattacatcttttcaagcaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctctctctctctctgtgtgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccagacaagggatgggtcagtgagcaagactctcttcctagtctcaggccatacctgtggcgccctgatcctattctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcgtaactgtttgcacaaacttgggacaaatgatattgggataacgatctactagaatagggacattttacccacagtttctgggagaaaaaccgaggaatttctatcatgaccagccttcaggcctcctgaaatatatctctcacagtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctgtgttaacacctggaggcaacagattcagggaaaccagattgtgtttgatgtcatgttttcaacgaaggctgaattactcctactgtcattgctgttggttttcattgcagtagatgtttaggtttccatttcttcctccccttatcatttcctaacgtaccataggttgaccatacttcaaaagctgtactctcatggccactgcatcgaattttgagcatattttatggaaaactattgagctcactcttttcatgatcacagtttgctgtgtgtcatgagggcactaactcagagtgtcctttgactcccttaccagtatgtcacctggccaattcactagctcactttctctctgtctctgtctctgtctttctctctctgtctttctctttcattgttttctacctggccctgttctatcccaacataaaggcaataattttttttttttacctcattaatggatctatcctttttcttttctaaccagttccttatgttacttctgaaatctagtggggctctgtggtgtctgattttccctggctgcttctttagttttgtctccttttccaggctcaacggcgtgctgatggaagtggaagagcctgaagtcttgcaggactcactggatggatgttattctactccgtcaatgtactttgaactacctgactcattccagcactacagaagtgtgttttactcatttgaggaacagcacatcagcttcgccctttacgtggacaataggttttttactttgacggtgacaagtctccacctggtgttccagatggaagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcagacatgtctctgagcttctatacctgctcaaggtcattgtcatctttgtgtttagctcatccaaaggtgttaccctggtttcaatgaacctaacctcattcttcgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccttatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacgctgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttttggattgttttttacattcagtgttataatatttgattatgctgattggttttggtgggtactgatgcgaattaataaaaacatttcatttccatgtttattttctaatctcttccacattgtaggctatgtttaccatatgtagcagaatgtatttacatttcttggttctagtcatttgtattcttcgtgagtgtgagtgtgtgtgtgtctgtgtgtgtgtgtctgtgtgtgtgtctgtgtgtgcctttggcatttaggaagggttgtatagctcatgttaaatattgcactaaaaatgtttttgatggttttcctccctttggactagacacacttctaatatttggtttatagttttaaattataactttcagcatcaaatatttccatacaacagtcaattacatgatgtgttttctttttcctacctcctttacctgccacttctcataatagtatttgaacctaaacatataccggtgacattctgtgattatcatcctgcccctaccttggtttttggtttagatccacaatgaaatatattaacgctcatgagctattcaaaagtgaatgtcacagtcgtcacttgctgagtggtactcatccttaacagagtcctcatgagggaatcaggtctcgctgagtttagcatgtttaataatcttttctcacggtctcgatacatggatcgcattactagatataaggtgcttgcccaaaatgatttttctggagtttttaggagatattgtcttccttgggggacatacatggtgtatgttctcattgtgggattctattttgttctaccaggacctctaatttctgccagttacttcattcatttgttctcttcaccatgagtctccagaggatacttccatggtccgtgcctccccatctcccagcaattctgcgtttccaagattggcacctctggtcctctgcacggtgaagccccttcctttcaattccccagtagccagtgctctaatccaccaggtctcaggcatgatctatgtttctccacactcgctttctgaggagagttttgcctgggttctatcatgaacaggccctccctgctgtcctggcctctatttgcatagtgtttcctgctccctctgctgtcgtgtggctcccagacctggctaaagaaaatcacctgagggccacagtgttccctagccctggtgtttaggggcaggattatgggtgagatttttgagtctctaacttgacccctacagctctgaagtgtatgttgagaaattcagctgttatcatcctaggtggacttgctccctcctatcctcctacttcaaatgcagaacttcaatcgtttacaaaagaagactgaatcgtataatagaacacacccttattcattggctggcttcaccaatctcatggctgaacttgtaaaaatacaatcttagccacatacctatgaaatgtatatgtgtgtatatatatatacatgaatttgcttctgagattatggaggctgaaattcccaagatggaaggaaagctggatatccaggaaagcatttgtttcccattaggcctcttaattctctcctggcccttgatggattgcatgaggcccacccctattaaggagggcaatctgcttcacttagtctgcccatcccaatgttaatcgtatctgaaagactctctggaacacaaccagaatcatgtttggccaaatgtcctggcaccctggtgctcggtcacagtgacaagtacaagtaactatcacacatgccctttgtcatattggtgatttccactgtttttctcccaaactgcagcttatatttgttctcttagtactgttgagcaaaaacttttaattttcataaagtcgaatttatcaatgttttctttaatggtttgtgtttattgataataaagaacactttacctatctctgtgtcatgaagattttgtcttatattttctgctatactttttctagttttatagtttatatttagttgcataatccattttgagttagtttttgagttagtattgaggttcaggtgaatttttttcctttggggataaaaaaaacaaattgtgtaaaaaaaagttgtttctacacaatttgttgacaagagaatgccttctccactgaatcatatttgcacctttgtcaatccattgggtggttgagactggtgagaggactgtcctggtgtttggacagagagacagggcatgaagtagggtggttcttatgggaaaaattaaggaagacacatttttccatgaggaataggaaatccccaagcacaattgggggtaccctctaccagcatgttgtagcacactcatctctgctctacctgtcctgctgcaaaagcttgggtgtgcatagacactgaggttgagtggtgtctttgggcattttgagcattgacaccaaagttccagcatcaaatcttagaatatcaagcagccagatggatcacctgaggtcaggagttcacgaccagcctgactaacatggtgaaaccccatctctactaaatacaaaaaaattagccaggtatgatggtgcatgcctgtaatctgagctacttgggaggctgagacaggagaatcgcttgtgtacctgggaggtggaggttgcagtgagctgagatcacaccattgcactccagcctgggcaacgagagcaaaactctatccccccgcaaaaaaaaaaaaaaataaaaataaaagaatatcaagcagccaaagaagcaggaaaacatgacacataatgaagaatctaataatctagttgaaattgacagacatgttggacatagaagaaaaggacattagagcagttagtataattgtattttaattaaatggggaggttgaagattttttaaatatcaaattctgtagataaaaagtatgatttacagtctgaaatggaagaaggcagtggattaaacattgcagaagagaagattattgaactagaaggaatagaagttgaaactaacataaatgaaacacacagtaacaaatgacttgaaaacataaaaagaccatcggcatcaaaactttaaaccccccagtatagggctaaatggaatccctgaagggcgtgtagtggagaagagagacaaagatatttaaaacatactggatgaaagatttagaagctccatggaaaccataaacttcaaatattacagaaatatgattattctaagaacaagaaacatgaagaaaacttcaccaaggaacgccttaatcaaatccatcaaaaccagtgataaaaaggaaatcctaaaaggaataaaaagggaaagaacatgttacatacagagcactaaatataaggatggcataagatttctcatacaaacaagaagtttgcaataaagaacttaaaaaaagaaaaactgtcacctacaattctacacctggccaaattatcttttaaaaataaacatgagaaaaagtatttttgaacagaaaacaaaatgatctcaatttgcagatggtgtgatcctatgcatagaaaatcccaaataatacctacagatgcaaacacacatacatgcacacagaggccagacacacacacacacacacacacacactcacatacacacactactagagttaataagtgaattcagcaaactttcagtaaacaatcagttgtgttagcaatgaacaatctgagaagaaaattgacacaatgatttcatttataatagcacttgtaagaataatatgcctgggaataaatttgttcaagaaggtgcagtacttgtacacagacaactacagaacattgctcgaggagattcaggaagacctaaatcaatggacagacatcttgtgtccatgggttggaagttgtaacatggttaagataaaaatacaactcaaagcaacccacagattcaatacaatcctatcaagaagtggccttttttacaggaatgcctaagaagaacttcatattcctaaaaaatagtgtgtccccccaaaacaaaagcaatcttgaaatgcaagaagaaacattttctattccaaaggtctttaactgctctaagcagtacttggtagtcttcaatatataggctttcacatctctttttttcttcttttgtttctgcacaggatctcactctttcacccaggctggagtacagtggcacaatcacagctcactgcagcatggaattctcaggcctatgacatcctagggcctcatccactgattcctgggactacaggctcacaccaccaaacccgggtaatttttctgattttcagtagagatgagggctcactatgttgcctaggctagtttcaagcttctgagatcaagcaaccctcctgccacagccttccaaagtgctgggattcgaagccaagcctggctggctttcatgtcttttctatgtagtttatgtttctggatgccattgagagtctggctggctttcacatatttgctatgtcgtttatatttcttgatgttattgtaaatgtttattaaaggaatcttttaaaaactttgttttggccaggcgcggtggtccacgcctgtaatcctagcactttgggaggccgaggtgggtggatcatgaggtcagaagatcgagaccatcctggctatcatggtgaaaccccatttctactaaaaatacaaaaaaaaaaattagcctggcgtgatggcgggcgcctgtagtcccaggtacttggaaggctgaggcaggagaatggcgtgaacctgggaggtggagcttgcagtgagccaagatggtgccactgcactccagcctgggcaacagagtgagactccatctcaaaaaaaaaattgtattaaaattatatatttaaggaattacatatatatttatatatatataatacatatccttaaattatatatatttaaggaatacaacctgaggactacatatacatatacataatgaactaatgcctactaggtgaggggctgccttgtgagcaaacccaaggtccctggcttatgaagcctttgtctagaaggagggagggatcagcaaggtgggcacgcagcaggttctgtctttggtgtgggcatctgcccactcgggtctctggcaatactaaccaggcttcacgatgggtgaggtgagctaggaatgggaaagtggatgacttcagatccagagactgcagttgtcacctggggacctggcgtaggcgtggaggagtctcccactgacttggccctgggtcaatgcccaaacatgcacaaggacgggactctcggcctcaatgctttaggagcccccagtcttctaaagagggtttgtggtggggaagaatgttcaacaaaacagaagagttatgggtactctagcttggcaacagagaatacttccttgtgctactaaatggcaatatttgacaattacggatgacacaattgagcaacagctttcactgtttaacaagcagtgtctctggaacactgggttagtgctgtcagatgttgactgaaaagtcagtggtttgagcccatccagtcatattaatgtttctagctgacgtgaccttccatctgaagagtctcttccttggaccaaatatctcttaaagcttctcttcctcttgtctcttgtctattttctaaggtgcctctttgttgcttggggcaaaaaaagtccatttttaatccacacccaacaaacatctacccttacgtatcctggtttttagggttttgagtttgttgtttgttttctcagcttctcatatttggaatactggaaattcctaaagtggagaatgacagaacgtgaatcacagctatggtgaagccacaggctctggatgaaaaacctaatctgccagggtttgaagttaaacacatgaatcttctgtgcctccatttctatctgtccaatgggctaaatcagaacacttaggttgtccagtgtttaaatgagcagtgcaggaaaagcgtgcagccaatgcctgtcacgtagtaattggtcaacacgcatgagctcctatcagctccatggtctccagcatttccatcaggctttgatctttgaaatgtccttcttgatatgaatggatcattcctcaaacattctctaactgatggccatgaaattgctccaatgtgtattattacaaatacaactgcagggaccagactgacacatgtatctgtcgtgcatcacttgtttatttctccgtagacacctggagatggaattgtcagaccaaagtatttatacatgtttgattttgctaatttctgtctaaattactgtgaaaagaagatataacatgtcatacttttaacattttttgagaattatttttttctccatcttctggccaaaactgggaagtacttgcctaccacttcctctgaactcacttttgccaacatttgtgtagtcatacagtgggatcacattgtatgcaagacctcaaactcaaatccttaaatgaaagcgattaacatgactgtgtaaaaatttatcttcaaaatacaatgaatacatatatacacatacttatatgggaaaggaattattttatttggataccttatcaaagttatatatacttgaaaatttgtttagtaaagtagcagtccccttgtgtactcccagagtttcatcacatagaagcaattatttcgttatttatctccttatgtctaaatagatattattactttttgattttcaagtttaggcactacctctccttcacatacttgctcatcaccaccacccccaaacacgcctctcaccaccttaccctccaacacgtttgtgtcctcatttgctgggtcaattgctacattgttataacttgtatattttattcagagttcagtcacattggatatacatagcaggaatgagaggccagtatcttcagggactctctctcaagtagataagcttcaaagatttttgcaatctttggtcaccctccccatcgttttcctattccaggtaagtactggatctgatgggcccagctcaggtcaggcactctctccttgagcaggggagagcgggacatcttcatgtgtagtaccaggaagacactgttcaaagagggacaggtagttctaagacagaaaagtctatctggggtacaggtaggcaaaacaaggacacacacacaaaaattagtctgttctgtgaggggagcatgcagtagagggtggattcagagtgggaggggagagttttgagagatatgggccatggatatcactctgtgggccggagccacacaagacggttggggtctctcaggggcagggagctgaggaggatctgccctccccaacctgggagactggtgaggggactgtcctggtcaccagacagaaatggggtctgggccagggcagttctggtgggaaagaaagaacaggacatctccttaaggaaaggtcctgagtcaggtcttggcagggagggaggttaccttgggcattggcagctgaagatggttggccagatgagggcactgaaatccatgtcctctaaacttgtagttcagtaaaagaacgacagcagtaaagggtctttaggaagaggaggtggaagacctgatttgggttgggggctccaagaagaatgtctgccttgctgtgcagaagcctgctacacaacctccctggtccccttgctcagtctcctggccagacccctgtgagccctggaagtgcacagtcagcttagccaaggcatctccagccaggactcatccctgggcatttctgtggccttgggtgccctggcctcctccaggccctgtcttgcaggcaatcatcctgctagggaagggggaaaggaggctacttgacagttaactctgagcagctccacaaggtcctgacttagctcctagtcacttacaaacctatatacccccatctcatcccccaaacgatgaaaagaaactttgcaggactcatgccagacaaatagggtgggaccattctgcagagccaagttctcaggacatcaataagagatgggaaccacctgctggaaggtgccacagtgggaactttggggtcagggagcagtcactgaactgtcagggtgaatcctggctcctggccctcacacaccctttctccccctccctccttctctcctccctcctgtctgctctttcccctctctctcctgaatccctcaggtaccttccatgggccctgacccctccttttcagaggctccaaagtgagccctcaaaacacttggtaaccttggacatttccaaaactggagagacttgaccacagcatttttatgagctaggaaggtcctccagagctcttgcctaaatttttctgctgatgagaagagaacaagagtgtccatctgatctggtcctaaggcaacttctccttggagcagagtctgggcaggaagaaggcggttgcccagggccctggacttgcccctcccagctgctctgctcctctccccttcactgcgggaggctggccagggatcaggaacctctattctccacagatgctgggattccaggctcaaatctaaatattggctgatttaggaggctaagggaggcaattggctggagggaggtgtcaggatttgggacaagagcagcatctagttgccgtccacagagaccccaaggacaggaatccactggtagctggtcggaggggatcccatgaaaacaaaatcaaacgcgcgctttagtactggacccaagatcaggagatgaaaaactgcactgtcctaagggatgaaggaattagggaatcccagaagtaaagcttttcatataggtcatttcttccaaagagacatagggcaatggcccaatgatgtgaacaaaagaaaactcggggtctaggattgaggggaggcagcctttttagtggagacctgtgacctggaggcccagggtcaccctgagaggggaggggtcttgctggtcgctgggtccgggactccaattgcacacagccagtggcatggagggtctgtgaccatgattgggcaatttcccccattctgcttatagagcaatagagaggaacctcactggaattatacagaaaggtcccagtgagacttgaactctgatcactgtattcagagtccaaagtgctcaccattacaccatggaacctcacactagcttataactggaggtaactgagttcatacttagcagccatagttcccacacacctatgttaaggcatttcttctgatccctcaagcaacaccaaggaaggtggacctgtgagagaggagtcatcctctttctctctgccctctcctttgatcaacttttatcatttcatttgcacctcagaaaatgaggcaaaatccagtttgggcttagggccagagaagagcccttgaggcctccctcatggaaaacatactctctcagtttaccagagtttcctgtaccaaggggaaatttctgcaaaccgtagtgctatattctttttgccttccctcttttccctttgcccagggaggccagatgattgtgagaacaggacttgggacttcctgggtgcctttcccccttcctccatgtgataaataatggctgacaccaagcaagtgggattgggaggcagggaatctttcatttccttcttcatatacttctatgcatttgtttggttggttttggcaagattttctaaccagaaatggagatttgttggatttaaaataaaaagtaatcagccatgttttacatttctataaaacactcaaaccaggccatactcccctgctgtgcctcaaaatcaaccataaactgtcgaggtcaggaggcagggccctcacacttaagcacagtgtgtttcctcagaattggccaagttgatgccactccaatttctcaatataccacaacccattaattgcggtttttaaaagtgtacatgtatttttaccaaaaccccagggcttcagtgttctcagcacacagaaagacaatcattgagacattgagtattgctgaggaagaaggctttaatcaggtgctgcagctgagtagacaggagttgagtctcaaatctgtctccctgattgactcaagttaggggtttatatagcacagaagaaatgtaactgtgtgtgggaagagagaaactagggaggggtgaggaagcacttgtgatgagtgaggggactggcatctcattgtctggatgctgtgattggctgagtttcaggtctctgatgctttttgagaggactgagagtcctttcctgaggaaggaactcagataaaacaaatataattttcttttatagaatggcttgacctcaggagtttgaaaccagtctgggcaatatggtgaaaccctgtctctaccaaaatacaaaaaaaaaaaaaaagagggttgcttccaagatggctgaataggaacagctccggtctacagcttcaagtgagatagacgcagaagacaggtgatttctgcatttccaactgaggtacctggttcatctcactgggactcgttgaacagtgggtgcagcccatagaggatgagccaaagcagggtggggtgtcacctcacctgggaagtgcaaggggttgggggatttctttttcctagccaagggaagctgtgagtgactgcacctggaggagcagtacactcctgctcaaatactgtgcttttttccactgtctttgcaactgacagaccaggagattccctcttgtgcctgcctcggcaagtcccatgcccatggagccttgcttgctgctagcacagcagtctgagatcaacctgcgacattggagcatggcagggagagggggttctgccactgctgaggctcgagtacttggttccatggtcacagtgtaaacaaagtggtagggaagctcgaactgggcagggcccactgcagctcagcaaggcctactgcctctagattccacctctgggggcagggcatatctgaataacaggcagcagacagcttctgcagacttaaatgtccctgcctgacagccctaaaggcagcagtagttctcccagcatggcatttgagctctgataatggacagacagcctcctcaagtgggtctctgaccaccgtgtagcctaactgggagacacctcccagtaggggccgacagacacatcatacaagtgggtgccccgctgggacaaagcttccagaggaaggatcaggcagcaatatttgctattctgcagcctctgctggtgacacccaggcaaacagggtctggagtggacctccagcaaactccaacagacctgcagctgagggacctgcctggttagaaggattaacaaacagaaaggaatagcatcaacatcaacaaaaagacatccacactaaaaccccatctgtaggtcaccaacatcaaagaccaaagtagtacataaaaccacaaagatggggagaaaccagagcagaaaggctgaaaattccaaaaaccagagcgcctcttctcctccaaaggaacacaagtcctcaccagcaagggaacaaaactggatggagaattagtttgatgaggtgacagaagcaggcttcagaaggtcggtaataacaaacttctccgggctaaaggagcatgttctaacccatcacaaggaagctgaaaaccttgaaaaaaggttagatgaatggctaactagaataaacagtgtagagaagagcttaagtgacctgcaggagctgaaaaccacagtatgagaacctcatgaagcataaacaagattcaatagccaattcaatcaagcggaataaaggatatcagtgattgaagatcaaattaatgaaataaagtgagaagacaagattagaggaaaaagagtaaaaagaaatgaacaaagactccaataaatatgggactatgtaaaaagaccaaatctacatttgatagctgtacctgaaagtgacagagagaatggaaccaagttagaaaacactcttcacgatattattcaggagaacttccccatcctagcaaggaaggccaacattcaaattcaagacatacagagaacaccacaagatactcattgagaagagcaaccccaagacacataattgtcagattcaccaaggttgaaatgaaggaaaaaatattaagggcagccagagagaaaggtcgggttacccacaaagggaagcccatcagactgagagcggacctcttggcagaaacactacaagccagaagagagtggggaccaatattcaacattcttaaagaaaagaattttcaatccagaatttcatatccagccaaatgaagcttcataagtgaaggagaaacaaaatctgttacagacaagcaaatgctgagagactttgtcaccaccagacctgccttacaagagctcctgaaggaagcactaaacatggaaaggaacaaccagtaccagccactgcaaaaacatgccaaattgtaaagaccatctatgctatgaagaaactgcatctattaataggtaaaataaggccgggagcagtggctcacgcctgtaatcctagaactttgggaggctgaggcgggcggatcacaaggtcaggagattgagaccaccctggctaacactgtgaaaccccatctctactaaaaatacaaaaacagaactagccgggcatggtggcgggtgcctgtagtcccagctattcaagaggctgaggcaggagaatggtgtgaacctggaaggtggagcttgcagtgagccgagatcacaccactgcactccagcctgggtgacagagcgagactccatctcaaaaaaaaagaaaaaaaggtgggaaataaccagctagtatcacaatgacaagatcaaattcacacataacaatattaacctgaaacataaatgggataaattccccaattaaaaaacacagactggcaaattggataaagagtcaaaacccaggggctgttccaagatggctgaataggaacagctccagtctacagctcccagcatgagtgatgcggaagatgggtgatttctgcatttccaattgaggtactgggttcttctcactggggcttgtcagacagtgggtgcaggacagtgggtgcagctcaccgagcatgagctgaagcagggcaaggcatcgcctcacccaggaagtgcaaggggtcagggaattccctttcatagccaagcaaagctgtggcagatggcacctggaaaattgggtcactcccatgctaatacagcacttttccaatgttcttagcaaacggcacgctaggagattatatcccatgcctggctcagagggtcacacacccacggagcctcactccttgctagcatagcagtctgagatcgaactgcaaggtggcagcaaggcttggggaggggtgcccgccattgctgaggcttgagtaggaaaaaaaagctgcagggaagttcaaactgggtggagcccactgcagctcaaggaggcctgcctgcctctgtagactccacctctgggggcagggcatagccaaacaaaaggcagcagaaacctctgcagacttaaatgtccctgtctgacagctttgaagagagtagtggctctcccagcatggagtttgagatctgagaacagacagactgcctcctcaagtgggtccctgactctcaagtagcctatctgggaggcatcccccagtaggggcagactgacacctcacatggccgggtacccctctgagacaaaacctccagaggaacgatcagacaaaaacatttgctgttcagcaatatttgctgttctgcagcctccactgctgatacccaggcaaacagggtctggagtggacctccagcaaacttcaacagacctgcagctgagggtcctgactgttaaaaggaaaactaacagacagaaaggacatgcacaccaaaaccccatctgtatgtcactatcatcaaagactacaggtagataaaaccacaaagatgggggaaaaaaagaacagaaaaactgaaaattctaaaaatcagagtgcctctcctcctccaaaggaatgcagctccgcaccagcaatggaacaaagctggacagagaatgactttgatgagttgagagaagaaggcttcagaatatcaaactactccgaactaaaggaggaagttcgaacccattgcaaagaagttaaaaaccttgaaaaaagattagatgaacgactaactagaataaccaatgcagagaagtccttaaaggaccaggtggagctgaaaaccatggcatgagagctacatgataaatgcacaagcttcagtggccgattcgatcaactggaagaaagggtattggtgattcaagatcaaatgaatgaaatgaagtgagaagagaagtttagagaaaaaagaataaaaagaaatgaacaaagcctccaagaaatatgggactatgtgaaaagaccaaatctatgtctaattggtgtacctgaaagtgacagggagaatggaaccaagttggaaaacactctgcaggatattatccaggagaacttccccaacctagcaaggcaggccaacattcaaattcaggaaatacagagaacaccacaaagatactcctcgagaagagcaactccaagacacataattgtcagattcaccaaagttgaaatgaaggaaaaaatgttaagggcagccagagagaaaggtcgggatacccacaaagggaagcccatcagactaacagctgatctcttggcagaaactctacaagccaggagggagtgggggctaatattcgacattcgtaaagaaaagaattttcaacccagaatttcatatccagccaaatgaagcttcataagtgaaggagaaataaaatactttacagacaagcaaatgctgagaaattttgtcaccaccaggcctgccctaaaagagctcctgaaggaagcactaaatatggaaaggaaaaactagtaccagccactgcaaaaacatgccaaattgtaaagaccatcgatgctaggaagaaactgcatcaactaatgaacaaaataaccagctaacatcataatgacaggatcaaattcacacataacaatattaaccttaaatgtaaatgggctaaatgctccaattaaaagacacagactggcatattggataaagagtcaagacccatcagtgtgctgcattcaggaaaaccatctcacatgcagagacacacacaggctcaaaataaagggatggaggaagatctaccaagcaaatggaaaacaaaaaaaggcaggggttgcaatcctagtctctgaaaaaacagactttaaaccaacaaagatcaaaagagacaaagaaggccactatataatggtaaagggatcaattcaacaagaagagctaactatcctaaatatatatgtacccaatacaggagcacccagattcataatgcaagtccttagagacctacaaagaggcttagactcccacacaataataatgggagactttaacaccccactgtcaactttagacagatcaacaagacagaaagttaacaaggatatccaggaattgaattcagctctgtaccaagtggacctaatagacatctacagaactctccaccacaaatcaacagaatatacattattctcagcaccacactgcacctattccaaaattgaccacatacttggaagaaaagcactcctcagaaaatgtaaaagaacagaaattataacaaactgtctgtcagactacagtgcaatcaaactagaactcaggattaagaaactcactcaaaaccactcaactacgtggaaactgaacaacctgctcctgaatgactactgggtaaataatgaaatgaaggcagaaataaagaggttctttggaatccacgggaacaaagacacaacaaatcagaatctctgggacacatttaaagtagtgtgtagagggaaatttatagcaataaatgcccacaagagaaagcacgaaagatctaaaatcgacaccctaacatcaccattaaaagaagtagagaagcaagagaaaacacattcaaaagctagcagaaagcaagaaataactaagatcagagcagagctgaaggatatagagacacaaaaatcccttcaaaaaatcaatgaatccaggagctggttttttgaaaagatcaacaaaatttatagactgccagcaagactaataaagaagaaaagagagcagaatcacatagacacaataaaaaatgataaaggggatatcaccactgatcccacagaaatacaaactaccttcagagaatactataaacacctctctgcaaataaacaagaaaatctagaagaaatggataaattccttgacacatacaccctcgcaagactaaaccaggaagaagctgaatctctgaatagaccaataacaggctctgaaattcgggcaaaaattaatagcttaccaaccaaaaaaagtccaggaccagatggattcacagccgaattctatcagaggtacaaggaggagctgatatcattccttctgaaactattccaatcaatagaaaaagagagaatcctccctaactcattttatgaggccagcatcatcctgataccaaagcctggcagagacaaaacaaaaaaggagaattttagaccaatatccctgatgaacatcgatgcaaaaatcctcaataaaatactggcaaaccgaatccagcaacacatcaaaaagcttatccaccatgatcaagtgggcttcatccctgggatgcaaggctggttcaacatacacaaatcaataaacgtaatccagcatataaacagaaccaatgacaaaaaccacgagtatttcaatggaggctgaaaaggccttcgacaaaattcaacagcccttcatgctaaaaactctcaataaattaggtattgatgggacgtatctaaaaataatgagagctatttatgacaaatccacagccaatatcatactgaatgggcaaaaactggaagcattccctttgaaaactggcacaagacagggatgccctctcccaccactcctattcaacatagtgttggaagttctggccagggcaatcaggcaggagaaagaaatagtcttttcctcaattaggaaaagaggaagtcaaattgtccctgtttgcagatgacatgattgtatatctagaaccccccatcacctcagcccaaaatctccttaagctgataagcaacttcaccaaagtctcaggttacaaaatcaatgtgcaaaaatcacaagcattcttatacaccaacaacagacaaacagagagccaaatcatgagtgaactcccattcacaattgcttcaaagagaataaaatacctgggaatccaacttacaagggatgtgaaggacctcttcaaggaggactacaaaccactgttcaaggaaataaaagaggacacaaacaaatggaagaacattccattctcatggagaggaataaacaatatcgtgaaaatggccatactgcccaaggtaatttatagattcaatgccatccccatcaagctaccaatgactttcttcacaaaattagaaaaaactactttaaagttcatatgtaaccaaaaaagagcccgcattgccaagtcaatcctaagccaaaagaacaaagctggaggcatcacactacctgactttaaactatactacaaggctacagtaaacaaaacagcatggtactggtaccaaaacggagatacagaccaatggaacagaacagagcccttagaaataacaccacacatctacaactatctgatctttgacaaacctgacaaaaacaagaaatggggaaaggattccctatttaataaatggtgctgggaaaactggctagccatatgcagaaagctgaaactggatcccttccttacatcttatacaaaaattaattcaaggtggattaaagacttaaatgttagatgtaaaaccataaaaaccctagaagaaaacctaggcaataccattcaggacataggcatgggcaaggacttcatgtctaaaacaccaaaagcaatagcaacaaaagccaaaattgacaaatgggatctaattaaactaaaaagcttctgcacagcaaaacaaactaccatcagagtgaacaggcaacctacagaatgggagaaaatttttgcaatctactcatctgacaaagggctaatatccagaatctacaaagaactcaaacaaatttacaggaaaaaaaacaaccccatcaaaaagagggcaaaggatatgaacagacacttctcaaaagaagacatttatgcagccaacagacatatgaaaaaatgctcatcatcactggtcatcagagaaatgcaaatcaaaaccacaatgagataccactcatgccagttagaatgacgatcattaaaaagtcaggaaacaacagatgctgtagaggatgtggagaaataggaacgcttttacactcttggtgggagtataaattagttcaaccattgtggaagacagtgtggcaattcctcaaggatctagaactagaaataccatttgacccagcaatctcattactgggtgaatacccaaaggattataaatcatgctactataaagacatgtgcactcctatgtttattgaggcactattcacaatagcaaagacttggaactaacccaaatgtccatcaataatagactagataaagaaaatgtggcacatatacaccaaagaatactatgcagccataaaaaaggatgagttcttgtcttttgcagggacatgcatgaagctagaaattgtgattatcagcaaaatatcacaaggacagaaaaccaaactccgcatgttctcactcttaagtgggagttgaccaatgagaacacatggacacagggaggggaacatcacacaccggggcctgttgtggggtaggaggctgggggagggatagcgttaggagaaatacctaatgtaaatgatgagttgatgggtgcagcaaaccaacatggcacacgtacacctatataacaaacctgcacgttgtgcacatataccctagaacttaaagtatttttttttaaaaagattatttctttgaataagtgttctactctttgctccttctcaagtccctctttaaggccaatgaatctttgattttctcttttcaggccctcttctagatctgttaagcattctgtgttcctgctcattcttcttttcttttttctcctctgactgtattttcaaatagcttgtttgcatgctcactaattctttcttctgcttgatcaattctactgagacccactaatgcattttccagctccagcatttgatttttttctcttacttcagtaatcttgttaaatttctgatatatttctgaattgtttctctgtgttttcttgaagttcattgcgctttctcaaaatagctattctgaattccctgagaggttacacgtctccatctctccagggttggtcactgagtgccttacttggtccatttgttgaggtcatattggcttcaatgttattgatactgttgatgtttgtcagtatctgggcattgaaggataaggtatttattccagcctttgcagtcaggtcttgtttgtacctgtccttcagaggactttccaggaattcaaagtgggctgacgagttccctaagccagtgatcactgcagccatttttgtactacagggcaccctaggcccaggtacactgcaattcttaccgattcctaggtccccagccctgtggacttgggggaagatcagggattgttctccgcattcccaggtaaagcccctagcttacttccctttctttcccccaagcaagaggaacctctcttcaggctgcactgcctggagtgtggggaggggtgatacaggcattcccatagctgctgcagctgctgccatcatactggctcacaccacaagtccagggtgttccagacctatgcagcatcagggcttgcccaaggactgcggccactacagcctgcctgccactgaaatttatttgaagcccaagaaatttccagtgataaagccggccagaactttgctgggttcttcctgctggggcagctggttcccttgtggcccagggtgggtctaaatgcttcttctgtgggcaccagcctggaatcaagtgctgtggggttctgcccagtgccgtgtatcactatggcaagactggtactaagtttcaatataaagtctcacactttcccccttgtccccaagccattagattctctctcagagaatttcctgtggttgggggagaggtgtcataggcaatgcaagactgtccttcctcccttcttcaatgcatcttttcttgttagcaagttaaaagcgggtgctatgatctctcacctggctagcccttgtgaaagtgttttcttacatagatagttgtttaatttgatgttccttcagagagaccattgctggagaattctattctaccatcttactccaccttctacctgtttttattttttaaatgtttctagtacataattgtgaagtgatagcttattttaatcttgggaatcaaaagcatgtagctaagaacttttcccaaggaatattttaaaatttttatatcaatgtttatggaatgacatactttttgattcaaggttcttaaatgtagttttagttttgattcaatgttatagaacactgttttttaaactgtgatctgaagcccacatgtaatggaatcatctggggtgcttatattaaaaaaatgcagattctagggctcacaccaactaaatctcctgggattggagaccaggaggtagctcctataatctccacagctgcttctcaggcacaccaagtttaagaaccattctttcatattttcagactggggattcttacaaaatgacaaagaaggaaaaccttaatcttttaaagttagagttcaagcattagactatatgcttcttaaacacagtttgtctttcccattttctctttccagttctttatactgtcaagggattggtgcagaaatgggaaacaaagcagtgaaagaaaaactatttatttctttatacacatcttgctttaacaatcaccaaaaagactttcattttctgtcacccaccctgtccaccagttatgttggccttcaatatatggcgttagcaacatatataaatctatatcatatatttatacacacaaacacattctaccagcactgtgaagacacagactaggctttactaggcttggggcctctcccatgccacttaaaaatgagcacaggtttgctctatgcaagaatttcaacagagttggtctggccatcagtctgcaatttccccgagataagatagggtgacaaaatgggacagcaactttgaagtgaggtcagtccaatttggatatcatagaagaaaagaaataggatgtgctaggttaagcctgagatggtatctgggaagtcaccacattcatgatgtgaactcaaagaacacaggtgctacagtgcagaccaaggcccagcctgactcgacccaacagggtcaggtgtggatctgtgagtagtgctcactgagcccccgccagcagtgtccggcagggcaccgctgctcagtagtgtgcttttagaacctgccagaggagctccagcattgggaccacgtgcccctttcatcggaatcagggtcctatattcactgagttttccatctcaggacagctgatgaggcaagaaatgtgctcttgctagttcccaagctgctggggctgttgagaggcaggatcacaaaaccttctgtgcaaactacgcatctttttcttagtgctgggccaagtggaccttggctaatcgtattccatagccgtcagaaaggctttctgcctttctcccagctccaccaggatacatctctgactccctcttctggaccctcccgtggacttggaggaatgaggcccagatgctcctcagcagataggtagctgcacaaaagggggacaggcccacctttcctgctgttttaaggacttctggtggctgcgcttcttgcatggttcctggaaggcaagggtcacaaggctggagtacatggcagagcccttagggatttcacctgcagacaaacataaaacaaaccaaatcagtgtatattgccaggccctactgatggctacctgaagctggagtgagagctacgtggtgaccaaagccaggagcacggtgagagccagttaagaggatgagctaagagcatgcgctgcagtctggaggagcaacaggtgcccgaggttagggggagcctccccacctccctgtgtgctgagatccctgctccaattcactgcacactgggtggctggatcctaccactcccccttcaggggccaggtgactctccaaatcactttgtctcagcagaaagaggcctttgccatctccacccaagaaagaagtgcttagcatgaaacatgcacatatagaaacagcctgtttgtaggaagaagaggacattttgctgggaagccctctgttaagtttatgtccagttgccataatgagggtgtggaggggccaagtccacagggacctcagagctcaactaagtccagttccatctttgacagatgagggtgcagcagtctcacagagactaagggacaagccaaagccacacagcagttagtgataagccagggattagaaccgaggcctcgggtcctttccagtgatctatgggaggtggaggggaaagcttccacactggagaaagccagtggatactagagatttttgggttaccttttagtggatactagagactttttggattaccttttctgggacaggaataaggctttacagaggcaatcctgtaagtgctgctctaaagaggctcaggaaagagaagaattatcagagaaaaacaaaagggaattagtgaaaaaataaaaaaaagagcaagttaaactggcccaagtcattttcacactatggagatcaacattctctcaggttatggattagaaacatttctaggaatatgctgaattgcttatggcaaagctttgatgtccatgttaaaaggtttagtttctgatttttaaccatttcatatacctcaagtttttcttcaaagcacttcctagggaatgattaacacttagtgttttaagtaaatgtagataatgtctggtacatatataacattttttccctgaaggttcagttgttatttattaacaaattcgcttttagaccaatgagacccaacagatctcttttgtcatgttacttaaagatatagcaaaatcaaattgctgttcttaacccgggaatgtgcagtgaaatcagtttattaggttgcaaattgcttttactttttcatgaagagtagaacacataactggcctcaagatccctctactagaagctcattcagaggcagactcccgaatgtctaatgacttcaagagtcagctgaattgcatttctccagtctctgaacttggcctcaaagaagaaaaattggagtaaaaaggagagatgatgacaatgtgagagtgaaccaagatacaggggcaggagctgacggggtgggagggtgatggggacagaaactagcaggatgctcactgaggacctgtgatcttgcaagtggaccccaagtcttctcctggaaggccaaagcaggccaagggtcacctacaagatctgctaacggatggtgatgggtgggggacaggcttggtgcctctgactggtgcagtagtttccttacctctaagttagtccttgccttctttaaaacatcatgtgttctggttactgaaacaacaaaagagcaccacagagtagaaaccaccagcagaaattaaccctacttgcttagcatgagaattctaaagcatttatttctttctggctattcagcttggagtctccttctatccaccccctgtcctccactccctctgcagccacaattgctcctggtacaggaggtttggggatatcaaatcagtctcaactcccaacatccccaagcccccctgatcacttctcatctgaagcacaagtggggcatcgggaagactgcctgtttcttcccccattccctctcagggaacctacgctggctgacaatgaactgttccatgctctccttctgctggttggcgttcttcagatgctcagttgtgctctgaaggagtcgctcctgtttggatactttggttctcagttccagaagttccctttctgttgattctccctggataagaggaacagactcttactgaccaggcagaaggcctaaagcaccctgtgctttgtggctctttccaattcaaagaaggattctacagtcttctcaactctcttgaactggatttcctccttcacagcctcggatacctccagctgaggacagttcaggatgaggccattaggcaggaataatgagactctggaattccccatgcagactagcacaggcctacacacctgtagcttaagagaacctcgcctcaggctggtatcaaactcccaactctgaagaggaccttgctttagtcctgatatcagttctgtcactctcccttcacaggtaagattgagagttcagaagtgttatgctggggtgagagatctggactcagggaagtctgcaagtttgtaaatatttgtgccaacatgaagatggcaaaacaccctctccctggaattagcatagttggatccaaaaggtattggtgccattgacctggaagtagaatccctggggaggggatcctgaaacctgcctacatgagggtctgccaatcagagttagcctgagctctgagcagatcctgaggggtggctgactttccccaggcctggtccagcgatgccagcttaagttgtatgttgggattccaggcagtggctaaaaaggctcagtctcatggggcattctgtgatcatttaaccatgggacctgaggggtgggagatgggtgctgaagctttaactgaatttcagctcagtcaaacttcagagaagtaaataaactgaacatttatggatggccagggttatgatgtctccgccttcttcacaccccttcatcttctttgatttcttaaccaggggacagggggctggtggggaatgggatatattcagagctgtaatgaaagcagccaccatgggtcagagatgtccctccagggacactcctctaagttcctgtctatcccaactcactatgtggctcctgattttctggaaaagctgtgacattgaggagacagaacagtattggagggcaggagaactgggtttgaaccaagaaagggcactggcatcttaccactttgccaggcagcacagggatgtgggtgcttggcagggccgctctccagaacatggtgaggagggaagctgactcctctagggcatggtgcagggcactggtgctgctccgaagctcatgaatacctttgctgcctagcacctggggaaaggtaacaccacaggagcggagagattactttcttccccctgcatgggctcaagcttcctttgtgagtgaggcatagaacatgggcctgcttgaacctgtgaagccctcacacaaccatttgcagctctcagaactaaggtgctgctccctttaccaggaatgccttcctccacctgcagaacccacaaggctttcaaaactcaccccccttgctatgtcctctatgagcctgttaccttccttgcctgagataaatgaccacatttgtattggcgctctcacagcacagaggatgacttctcatactgtgcctgtagccccttactgtgcttatctacttgggtgtgtgtcttgccctctagtgtgggggctccgtggaggcagggctgtccctacgcatccatgggtctccagcagctcagacagcacagccacaggttcctggtctctctcactggcaaggtgctctcagaagctttgctgactgccttccctccctctatgcagtctgcacaaggaaatgacatggctgccaggcttctcaccccttccacatgtgggggccatacacctgcaaatccttcagtttctatccatcccattgagttgactctgcccacagatggtcatgtgcctgcatgactatggtagataataagctaccaaaggctgctaggcaatgccacatgtttctgtggggctgaggggaaatatccagtcagctacatctggaacagagcagaactcacagtgaaaataggagatagagaagaaagggcctggctgctatacatggaagaggaagtctcagctgttgagagatgcaaagcatgaaaaaaacaaaaatggtgggagaaggagttaacatcaaaggaagaaagggcacagggaaagagtgcacctaaagcttcaggtgtgattacctctgtgccttgggcttcaaggccagggaagctgcacgctgatctcacaagagacactatctttttgaccagcagcttgccctccgcaatctgctgtcttagggcactgtagtcatcaatgtggccaatgacatggcggccatgcttattggcaaaggagccatcagtagcatcaccctctagcttgggaggggtcttcattactggagaagtatccaaacccaagcctgaaaaagaaaatgacaacacaacagaatcttctgttattcataatgatatcctcagtttgctccaactaaaaaagaggtagggaacaagaaaaggacgaggccgggaacaagaaaggaagcctgggaatgtacaagggtggggcaaagtccatagagatcttctggcttctatatttttataatctttcttacattatctcttaatgataaatttgccaggagacaattttttccttattggcaaatgaaataggatgaatcataataaataataagtttctgagtagagaagacacagacaaggaagtcaagctggatacagacagcattttcaagaatagagagattatggtgcaatgaagcaaaaacagcagtaggaaaactacaggaggatgaacaatggcaagaaaggcagccacagaaggtgcagggagtagggctaaaggccttggggcatgcagagaaaactctctaaatacagataatatgtttagagacaacaaaaggttgtttgcattaatcactttccatcatcagtccctgggccctttagttgccatatttaccatttgctctgttgattatgggcgtttctgagccaggagtagaggaagcagagctggggaagaccagagctggggaattcataccaacatcccggactggaggggacacagctgaatctagggggtaaaggcaaccacagttttcaggagccctggaacacactgcacatgaagcacatgcacacctagctgtccccactgagacctaaggtggcaggactctcctcttacagaattatccataccccacaagccaaagcaaaatcaaaagcctatgagtcactgagttcagaatgtttccattcttcagaacaaaaagatattcctgtaattgaggggtgttccatgagaacgtaacttctagtttgaaaaattattaggtgtatttttataaaccgagtcttaagtataatttgtgtgtggtatctaatatgatgccctgtaactaaatgtaatatgtataaatatacatagtacatattaaaatctagaatcaaagaatcaaggaatgaatggattcatgggggactcaacattctagtcatcattctgatgaggtaatactgaaaaaaattgacttgtatgagaagaacggagacagaaggcttggtgggttaacattgtcttgctggagactaaaaagcaaccctatggtggaggaattggaaaatatcacaaagaaggtagaaaaggtcctgctcaggcaagtgtggcccagtgcctgctttccagctcaggcctccggggtgctagagaaagaggggcagggactgcatcagtggggctgagtcttggctgctgtatgggaagccagtgagagaagaaggcctggttagaaggaagagttggagacataactgaacaccacaaccatcagggcagcccagaggagggcaaggtgtccaactaatgtaagctgagcagtgcctggtggtcaggcggtttgcttggtggaccacatgtgtttttttattgaattgccaaaacagcataatcatgttattgtcaccttcatttgacaaataaggttactgtcagataaatgagaatctacaagaaccacagaaaaacaaagattaacatgacccagaaatagctggcaggagagtttgaaagctcagctttagagaaactgaacagaagtggttcctgatttgaataaaattgaaggtatggccatggaggtgagtggagatggtgtactaaacggtgtatcaaaaggagaaaaggacagaggaagtagaaattgaatgatttaagagactagggggacaccattgacatttcaatgaaaactgggagaagtgagattgatagaggatattgagaagggggacctggtcaaacacgcctatctgaaaaggcaggcaaggggtggggtagagaaagcgaatgatgaccacccgaaataaatcacccaccatccaggacttccccagagccctgtttccttaggggcaggaacattttaccatacactgagttccccacctgtgagggaaagggggactagagaatctgggaaggtcggcaatactgagacagggcacaatgagctggaaggaacacagactgaaaatcacaacatctggttctgatcctggctttgtctataacttctctaaacccccgcttgtctgttaatatctcaggacctaagttttcttatgtgaaatacagagatagcaaaacctgctttacttcagatgaaattatatatgtgaaaacacttggctaaaactaaagcaccaagcaaatccaagaaaaagatatgaacatatacagctgctaattattgagtaattcttagtgtgccaagcacttgtaaatgatttcatttaatgctcaaaatcatataaggtacatatgatcattatcctcatcttaaatataaggaaactaaagcttaaacctctgagactttagacaccttgcccaaatcaaacgacctctaagtggtaaactcagaatctggagcccagtctgacctaaatcccacgctttcactcaggttgctagactagagcatctctgatttcaacctgaccctaaggagcatggaccaggcagattacaccttctgccgcagaacttcctggtgatctcccgactggccaagggctttctaagtcccttttccttcctaccttggaggagcagctgcttgtttccagggtcagtgctggctgggaagttctggttaatggaggaggggctgaggctggctttgccagcaccgctctccagctgctgttgcagctgcagtcgcagacaattgttcccctgaatgctctgctccagctgccctctcagagctcgtacctctgccaccaggtggctcaggtcactgctcaaagggatttggtgacaggcatccaggctgtaagctgagagagaaggagtctggtaacattgacccaagtatttccaagcacttgtcagaaccctcctctgtgacattcttttctgccaaggaccccactatcatctgagtctcatgcaacccatctgtgatggagatgtcaccatttctgtgtgtggcctggggatggcactgagctggcacacatccagtctgaaacttccctgcggcttaagttacacacatgcacctatagagcatttgattggcagatgaagataagtccatatttcatctccatagtaaccttaatcctgtaggctaaagtataggatactccaaggtagaaggtcagcactgagctagagaagggtaggggatgaggaagaaagagatttcatagtcctcactctcaaaaatgaaagagaaggaggaggtcttttggtagcatgtgagaatgtgagttgggcaccttagacgagggattataactgagtttttcaatttctctctctctctttctctctctctctctctatatatgtgtgtgtgtgtgtacatatatatacacctacatatagtgtgtttatatatgttgtgtgtatatacatactatatataggtgtatatatgtgcacacatatacatgtacatatatatgtgcacacatatacatgtacatatatatgtgcacacatatacatgtccatatatatgtgcacacacatacatgtacatatatatgtgcacacacatacatgtacatatatatgtgcacacacatacatgtacatatatatgtgcacacacatacatgtacatatatatgtgcacacatatacatgtacatatatatgtgcacacatatacatgtacatatatatgtgcacacatatacatgtacatatatgacatgtacacacatatatatacatacacatatatataaatatatatatgtatatatatttacctccattcaccacatggctatttctttgtactggggatgaagagatctaagaaatattctacgaggctacaatcccttatctgaaaaccttaaggccaaatgtatttcgaaaggtaaaatttgttttagtttttagcaaggcaacagggtgcatatatcatatataacatgtacccagttgcatgtgagccacaatcctttatcaaacatataactatttccgcaatgagctatgtgaatattctaagtagataaataaagacttatgaatatcctcatgtcagatcatctagattttgtcactaaatgagtatttgaaaaatttaatttggaaatcttactggattttgaaattacagataagagattatggagctttagtggttgtagctttgaaatgagtcctaaaaggcagggagaaaagcatgaaaggaaaggtagctcaggatgaaccaattttagggactttggtaaataatctactcttgaattttgcccaaagttttatgatgttcctctctctctttctcaacccaacttctcactaaattttgcttattttttaagagatgttttaaaatctatctataccctttcatcttcccaatagcaccttatattagactgtcatctcttaatgtgccagaatatcactagacccatccaatacgtttcccagattctaatgtctcccaattccaggacatcccctaagacttagcatcctaaagttctgttttcatcatatgcttatcttctttgaaaaagaacagacttagtttcattatctactatacagaatgtcaacttttaccctgacctgtgagctttcaagatttggtgactctgctccaccatcctgacttctcactccaacctcaagcttctcctgtggtcaggctggtcccactgacccaacactcaccatgactgtgtacttaaattattctcccagcctggtgagccccctctatttcttcaggttccagttcaccttctctttagaaaatcaggaaactaaatcaggatttatgataattctaatctaacttccactgcccttcactctttgtttagccttctggagggacataaaatacatgagttctttttcacctgacacttcttcaaatatccgaagccagttctcatgtcctcaagatcttttgaaagcctacatttctttagtttctttgactagttggagatttctggtccacaccattgtgcgccctgtcttcattatgttccctagtgtgtcaacgcccttttcaaagatggtgccccttaatctaacaatattttagacatggtctccacaggcgaacatcacacttacactactgtagttccagtttgagctggcatttctagcaacctttgtcctacaccttacttgtgtgaacatgtttctaccaaaccccaaaccctcatgtccatgaatggctgcctgtcctatatttctaccctcatcctatatttctaccactgatatttttaatcaagctcaggattttgctttttatctttgctaaatttcacgacattgatgtcgtcctctgttccagcctgctgtgacttattcacattatgttttgaatacccttctccatttaaagaatgaagaaatatatcaaaattctcaaatattagattattatttcagcaggcagcaaagtcttcaataaatgtccttaatatttaaatccaggattgaaatttaggtcctattagtggtatttctataaggtttttttgtttttgtttttgtgtcttttaattttctcctgtgggcaggctggtccccactgactcaacactcaccatgactttgtacttaagctattcgcccagcctggtaagcccctgtatttcttcaaattccagttcaccttctctttagaaaatcaggaaactaaatcaggatttatgaaaattacatgagagggcaataagctgagcgccagatgtcactagggaaagggtcagggtgggagcggactgcctgctgcattgggctgaatgggttgtcagtatgtatcaccgacaatattaaaggccttttcaaatgatgatatcattaggacagttcttttgctttcaaaaatgttacaatctagacattgataggaatgtctagattttcttaaagtaattaggaatgatcaggccggatcttgctcgtgccaccaacctgtcccgttgggctttgtgtttgagagctcctactgggagccccaggctcgggtgggggtttctgcaacagaactctgtagcttcccatgatctccacaactcccaaaggaaagacctcactagcatcctatgcaagggcaaaaagctcatggggtgaggggagaagaacacatacctttcagccccttcttggaattgccataaagtgcctcgtagatttgtagctctgactggagggactcaaagagctgctgtttctcttcacactgttgctgcaggagaaccagcttgtgctgcagtctgaccagggagaggcaaggcccactgagatggcagagctactcagccacaccagagcaacaagctgagagccagatgtcaactcagagggtcataaagggttacagttagggttacatctgagccccagatgtcaactcagggggtcatgaagactatcacttttatttcgcagatatggaaatggaggctgagggaggtcaagtaactttgcttgaaaacacaccattacctacattagttcagagcagaacagacacaccagcacagtctccttactgttcctacagtgctctttgcattctgacaagcagttacagggcttatgctgggaccaagcatcacagccagtatagaagcttcctaggtgatggtgagactaatgtcctatatctaattggaagcatgggaacccttctttttcatgtctctgatatactgaagacttctataacagagttttactctctcaacttgggagtgacaaggcattcccagagaagtcctttcttctgctcaaagcgcccctccccccaccccactgacacacaaaaatcaggaatagcagagggaacatttaggtttccaaaagaggacatcaattgtcttgccaatatcccttcctcttgtaatgtaagaatgaatgtaagaatgaagaatgctaccttctctgtcaatgggtcccctcttacctggagtcgttttcctggagggaaagacgttcctccctgaaatgcaagacctcttgctgcttctccctcaagtcttccaaaagctgctgcctttccaccttctggtgctccagctccttttccagctcttgaaggtgggatcgagaggacagcagagcctccctcaggctttctgtttcctgggagtgctctggtgagaggaacacaggattgatttattatcatggggccagagctcagctggaagatgaccccaagcacatccaccctgacagacagagctaaggagcagggaaggaaggccctatgttggtgggaagagcatgctggctcaacatcccccagagcctggagcatggtgcctctctctctttgcaaaacccttcatgccacttatttaatctgtcctaccttgctcttagagaaattctgctttctaatgatcaccactttccaagtgctcacatatcgtctgttcaataatccattcttgaattttgacaaagatcaacgtcaagatttctttttggatctcattttcattattttgaaaactgagattttttgtttttgaacttgcagcacttctctgatcttcacaagttgtcaaagattattgaagggactctaaaaatacagctgcaggctcagtaagtcctctggggaaagagtcacctgagcctggcaaattgtactcgtttaaatctcttactgtcttctcacctgctgaggtctgttctattctctccaagcatgcaatggtagctcagtagttctgccctctttcttatctgttaacttttgttatcgtcccccagcagtgacctttcctctcaaatcttctcgctaatacagaaatcaattaattaaattaattaatttgggtggctaatttagaaatatctcttggtggctttttccttttccacaagcattccttcattctgggcttaatccttttggatactaccctcagtcttttcatggctgttcataaatatttgtgaataaaaatactttgttatcgataatacattgatctgatcaagtagactaacaccaaggtcagctgcctcccagccacacgagaaatgatgcccacctgtgagcgccccctggctagggctgggaaagtgctggggggcatttgctagtgccactcggcatggagtcatgggagtactgaccagagggaagccctgagtctatgagtgagagatgtggtgaggaggcagagggatggcacagcagggccaggagcgacacatgctgctgcagtaaagtctggagaaacttgagagggaagataggcattcgcactccctcctttattggttccaagtcagttgtgagtgaagggaggtagagcagataccagactggtatccaaattgatagcttgtgactctggatatatgcaggtgggcttgtacagaaatgatggatttcctagagctcttcgcttctggggactaggagtctgaggggcccatagttggaacatcttagaaagcagccttctctagactgagaatagctgtgagtttgggttggtggatctgagtagctctgttacctctaccttcttctgtttgcttctccagttggtgattagtgtggccagggaagaaagaaacttaagagtgaccacagtttgtgggttttgaccacgtacctctggaaacatgactcagttgagcctgaagtcttcgattgtcttccctgaggactctgttctcattgcagagctgaggtatggactccaggccctgactgtagaagttagaagtggatcctgtcccagaaagtagacatttgggtaacagaaactttcaaaagtttcccattcgttatctctcaaagatactgccccaacccagcagaaaaccccaaggactgaaggcctggccctgaatgaagcgtggggggctgggtacatgttttctgtgtgcctcttctcagtggattctttgcgtgcatcatcacatgccgtaactgcaatggtgcaggaggctcgatctccctaaacagctgctgctgtggtataggcaggacaacaacatatggaaagactggcctccacatgacagcagcttggaaggagagtgtaaggagaaaggccaccttggtaaagaggcgagggtagaggtgggaggacccttacagacctggttccaccacttatcaatcacacaacaaaggcacagacatcagcagtatataagcagattaagtatggggtgagaagtcaggtgactctgggcatcagacgtagttctgccttaaagagagttactctctaaactcagatatattcagaaagtagggatgacagtacttgcccacctcccttgctggactgttcataaggagcgagtgaagtaaagaatatctgtgaagctctgcctaaaagtccctaaatagagccagaaacaggaaggtctgggcctctcctaccccttccacgagcagtagaggtcagccggtgttccagttgctcccgtaggcggtcattgatgcagatggattcctccaggcgctggcgcaggttccggatttcaccaagatgctcttccagcaggtcagcccctgcggccaaaccaccaggacatgaagagaggtgggagatggagaatcctggttactgatgggggtggggctcggctaggggacctgcagcaagacctgtaaatatcactagccttctgccaactgtgtcctctcacacggacacccaaaagaatggtagttttgtttaaacagtcaatgtgctttcaaacacatgacagtcacttgctaaaaaatctccatgggcctcctcccacacaggggtcttgtgagagttccacgttttagaaaaataactgagggctctggacaaggcctgcctagcatctggaaaggtgtggccacctcctgggtgtgactatgaggatgataggtgagacctcactctacctttcttcttactgacacgtgagtgagcattctttagcaagggacaaagcccttcctcccacccttagaaagaaggcctaaagtaaaagtacgtgatcttacactcaccctatgcggttaatgactgacactgaatgcttccctgaaatcacttttaatatggaagatgaaagaatagcctggaaggatctagagatctgaaggcaaattagagaggggatgacaccccccttccccctgccaaacaaagcaaaaatatccagaaaagtcagacggatgcttacaccggacattaactgcaccattttgctttgggctcagtcttttcctgaaaattacgattgtcttactgttggaactgcgcggcatctcagcatttatgagcttagctatacctctccacttgctgtgactgaattttgtgcacaggatatatttgcagggtcagggagctgcacccttacaccctttcctgtgacaagtcctgactgatggaagaaagtcccatctatgcctggcattctggaagggtctaagagagtgggctgcaaagaggccaggctgcagagggatggaaggacatgagtgtgacagcacaagaggtgggtccctgactttcccatatccctacagagcactgaggccctgggcaggagaatgaagaaatgtacttggaaaggattgagccctgatacagctcttgcattttatatccactctgtgagccagggatggaggaggaatgaaatagtcctgcctgggtaggaaaagagtagactccaaatgagacttcttttcaaaggctgccatctctgctttgtgctttacctgtgggtttggagttaagctggtacacagaggagcctgaggataggtccccagatacactccctttctgaggcctcatcacatcccacttgccactgctgcccaggtacccaggctctaggattcttcccagttctatggtgccccttggaggagagtgaggctgggcagagttgaggtagtaggaagagtcggcttccaagtcgttgctcagcaatgtagctgtggaagcaggaggaacagtgctggcacctgggcagaaagaaacattagtaagaagcaaatggggtgtcagaagggaagaatttgcaaggaagtgtgtgattgctaagaatagagactaaaaggagacatgtggaatgtcagagatcccagttcactttggtatactaattagactaaggcttgtaacctagaggttgtaactcttaccctttgtatttcctagcaggagacacaagaggtagagaataaagtatcttaaagtcatcagtatatacaatggaaaagtccagtggccccactcctggatcctactataatccttcatgacagactccaaggaaagttctaaaagtaggattcactcccacagttagaagttgtgagtgcagtggaatgcaggattgagcttacctgtgaacacgaacatctgtttgtctacatgtacttgccttcccctgaaactaactagtcaatatgtccgttccacgttggagtttttcagaagagaaaggggacatgaaatcaagctggatatggtggccctagttcctccagactgaagaactctttgctgaggctggggaagggcctatgtaaggcaagtatttatttggatcccatccaacatgactcaaggagctgcaaaatgtcatcactcctgtctaaagaatcattgaatacaattccacagaggcaggtaggacctttcatttaataggctgatactttcatagatcctttgaaatcataggcctttcccttgagccccatcatctccacttctctgtaaaaagaagcctagcatgggggagatgaggaaagaggtgggcagagacacagtttaggagaaaattcagaagcctgctttctttcagggattatgaacatgggcagcagaatagacaggtagctcctcctaagcaacaggagtgaggtcactgtttcttccatccaagccaaactccttggaggggttagtgtaaatgccacttgccagtttttagccctacttgtagctggttctcaaatgtgggtacatattggaatcacctgagaaagtatggaaacatatactgattcctggattccagagattttgccttagtctatatgggatacatcttgaacaatggatgttttaaattcattttaggtaattctaataggcagaagtttgggaagtcttgtcatgagtctctcttctaatttgcaaaatactagatgttcattaggatcacttagttaaggaagaaggttaaaaatttaagcacctacattttagaaggaatgcaacaaatacatgatttcctacctctttcaaactgccttcaaccccatccgaacacaaggcaaagggagaaatcagtggttgcagatagtcagcttactttttaatcaaggccatgtgaggttttaagtctatcagtaacaatgatcagtattctcatgttccagtccattggccacacaatacacagtacatgctctaaaccatgcaaagataccatacagactcttgcacaagattttaacccagggacctgagaggccaccatgcaccactgtccacacggaaacttggctcaaagcaaacaatgagcatgtataagcaatggtcccttggagaggaccttgacttcaggtggagaaagaaagggctacaatcttcctcatctaggctgggaccatttgaactccggtcaatggcctcagacttgatgtaattccaatttaacccaaaacaacagaccctttttcatggacagtgctctccttccatccttccgtttgggcaaagacaaatggacaaatgtggaaagataaaggaaaaggaggcaagataaagaaatggaagctagaaaatactcttgccatttgtcatgggacacatttgttgcccattcattgttggtgccagaactgctaaaataacaagttttaggtcagaaacagcagcacttcctactggtctctaaagagagggaaaaaattgttgcaacgagtccccagagtttgatcagctgagctcagctccatactctaagcaggatggtgacaaagccatcctaagtagaaaagatataacagaaacataaaacctggagcagaagaccagattcaaccccatctctcccacttaccagtgaccttgaacaagtaacttcacttccctgagctttacagttccctgcattagacaaagtacccatttcctgggttgacaaaataaataggctaagctgggtgcagtggctcatacctgtaatccctgcactttcagaaaccaaggtgggccaatcacttgagctcaggagctctagaccagtcttggcaacatggcgaaaccctgtctctacaaaaaatacaaaaattagccaggtgtggtgacacacacctgtaatcccagctacttggggggctgaggtgggagagtcgcttgagcccaggaggtagagactgcagtgagccgagatcgtgccactgcacttcagtctgcgtgacaaagtaagaccctgtctcaaaaaaaaaaaaaaaaaaaaaaaaagaggaagaaggaaagaaatatgctggtccacatgacatttggggctgtagggagggggatgcaaattcttggctgttgtcttgcatcactagaaacttctggcatggtgaccctatcagtctctggctcacctaagcttctttacaggcacagaaagtgcctgacaaatgagtttaagttcattcaaactgctttttaactgttgtgcctaaggtgctatgaaagagcaaattcatgtgaaggttgtcatttttttctaagctatcagtgaccaccagcacactaaatttatgatgagcatccagcctacaaatacatcaaagcactttctaaaaggtgactgtccacagtctacgtaactacatgagatcaattatctttgggagtcagaggatgggattcacagtcagatgccatagctggtgctgtggttctaagctgcctacgtgtcacctgtcccagggcagggaccaaccctgtgcagtaggaaaaggggctcatcatttcctcttctgaatccctctatcattaccctttttgctccaacctaatgatatcaggaactgaacttgattaacagcatttcacagcagaaaaacataatagccacacaaaggagcccactgaatgtggccatctttttcttggccacttcatcctgcataggcaaagcataacatctctctcccacccccaaccaatgagcagtccaccagtctgtcagggattcagcatacttggtggtatccaacactgtctacagtgtgagagcaccaggtctagagcctcgtgaacatatctacctgttaactgatgagacatacacaccacagaaataacagtaaatacatttccaaaaaataagcaaacagagctttccctccctcttacatttgtaacgtgtacccgtgttgtttttttaaactctgccatccagcccgagccatgcagagcaacacagtgtggggctgccaatcgcaagcacacaaatgcagaagtgctcactttctcccaactgcttctgcagcatctgtagctcctgctgagcctcagccaaggagaccactggtgtctcacagcagccaaggaggagagggccagtggggctgaaaggcaggaagctggatggagctgagggcaatggtgcctgaggaaggctagccagcttgggtatggagtgaaaatgaaagcctaggaaaagaaagttaaggagaaaagagacacatcatcaagagaaaatgagagaaaagaatgggtaaaagattgagaaggtaaaagcattccctgaccagacatcaccctgcggagtggctatcatctagtgtggtacaggataagacagccaagggtgaccattgctaccagaggctggcctggctgaccttccctcttctcccctgccagggctatcctgcatatatcctctgtgttcatcttgaaagcaattggctaaagaaggtaaggtggcattattgagccccaccccagcaatcctggacatggacaagtcagagagcctgaatgctttcaagggcccctggggctctgctcccagcatgtatcagtccttggccctgggacaagactctttctctacctagaactcctctttgacagcatcaggtcccatcctgagtaggagagatgtgaacaaaggctgtggggaaattttcattactagtgcatgcagttcaggactctgatggaaacaaacttcagaattccaaatcaacgtgttcattgaccaaattaaaaatagatgccttggtagagtggcttagacaaaatggcttgcaaatccttctgggcatttaaatcacatagcaaaaacttctaatatatgtagattctttaggccttcttgattctgtctaggccttaatgtagacttacagaattataaattcttggaacatgaaatttacatttaaaaaaagtcttccctggtgatctttaggcagcccatctacagacaggtttttagaaaccctggcaaggttcaatgtttaaaattgtttcctcttccctaaaagcaattaaagggcaggtagccaatggagagggagcagaaaccaaggctgacccatagagaatgtctaatgtagaagacaatgattatatcctaaaacacatcccaatggtgctggcaccatttcagatcaatactgcaaatatactcaaattgccaggtaacacagcccaggcattctttgaggaggcattctgattttaaaatcctctgttctttacctactgctctgtttgaacccacaacatttaagcagatgtctataagtctggaagcacagcttttcctcatgattctggtccagctgctgcctactctggcctagaaactttgaaaccaggctcaggaagcattggaacacttcctcttccttaagattttagttgaattgctttcagggaaatgagggcagcagaagaaagcactgtgctttctgggagcacctctactcaagtcaaacctcacaacaaaccacactgaaggcagccagccagctatggtgggaggtaggaggcgaagacaaggtttgccttttcttgccatccctggtacagggctgtgaatgagcagtgtaccctccggcaactaagctgaacttgtaaatgaaatgcacccctttaactgcccccaagatatgcactatgtacatatcaaggactgccaatccattcatacatccattaatggtaacgtactatgaacagaaccttgtctgaggctgttctcaccatccttggctacaagtagcactacctcttgcagaggatctccatgcagatttaatgggtaacacatacagtggatcaatagatgtgaatttcttttcatcctatggctgttgtaatcctgggagaaacattttgcctctttgctcccaggataaaatgagagaaaaccaataaaaatgtttctttttaaatgattagccaactactggtcagaactggtatgcagatcaaaacctgatgtggattacttattttctaaaatattttcttaaatcagacacaactggaaaatgaggatggtttctcgattctgtctaggttttgatgcatttaggcccctaacagtccaaacctctgtcgttgaagaaaaatcaaacaggcagcagagaaagaggagatgaagcttctgccccattggctgttgcatacctgaatgggcctggttggcctccttgggggtattctggggagttggcaagctgatggggttgctgttggattcggccttagccccctgagatgcactggttgatgatggtttagaagacaacacagcagaatgactcgaatgatggatggaatctataaaatccatgaatgaaagaaaacgtatgatgttctacagagaactggaatcctggccttatgtttacccaggggtaccagggctagagtcttgctttcagggaaagaaccaagcacaagcactgttagcagtgttcattttcttgcttgcagacagctcctatagtgaggcaaaccaccttagggatgacagcggtgctctgagctctgaaacatgaaaatggcaactccaaaaatatcaggcaagactagcagcatctgtggacacccaaatatacttagggaacactgctcaggaataagtagcaagatcattgtaggagagatgaaggaggttttccatcttaaagaagatctatctgacagagtcaccaaggaagaagagtctgccgtgatcttctcactctccccacagtggctcactttgtgcccaacagcttgtacgtgcccatggaggccacggtgacagaggtaacttgtagagtcaggagcagagcaaagatcctgatccactggtgcctgtgcatggcacttggccccacagccatgttcagcctgatacacaccatggtggagctataagccctgtttcctgagttctccactcagcctagacaaagatggtaccacccagaaagtggaggctacctgagtgactgggagaagctttcttctcttcatagtgtgtgtactcgctgactatgtccatgtcagagcaggcttccagttcatcagacaggaaagaggtgctgctgggagagcggtgggagtcagacaaggcatggctgctggagggtgtgagggaccgagcatccagcttggcctgcaggacttcaatcactttctccttctcctgcagctccctgctgagcctggtggggagaagggggacaacgggtaaaaccaaggtcaccgaagccaacctgtcctgactatggctcataggaaaagccaagtaagccaaggggaccatgcctgcagataattatggaaataacccacctctgcttagggatggagtgtaggtggggtgtagatggagagagaatagctacctagtgctctggccacataatatgctgaggacaagcaaagacatagctagccctccttttaaggcactgctgcttaatgtatgatccctggaacagttgcagcctgcgaactgtttgttaccatctccaacaagacaagtataaaaattgaaagcaagcattgagaaacacagaacaaaccactgtcccaacatccaagagcatgataagtggaatcatgtaattaactgaattcagaccatatatgtttctatgatagattagaaataaaaacaaaacaaaacaaaaaaaaccactgtgtccttcactacagatactttcagaagcatttatgtagtctgagacacaagcatgacacaaagaaccccaactagtggctacaacggactctgagcccgtatttcattgatcattatatgaagcaactcactgagaactgggtcctgaggcactgcagcctcctggtgatctacaccatctaggcctctttcaccaggtcctgttatatgattccttttttcccccagggcaattgagtgactattaaattagctgtcaacccaactttggaaaaagctcatcctgcttattaaacacacagcaggaaagcaggacccttagtggggcagaagactcttgaaacctagttagttcacttttagctcagactgtttctaggttactaagcctggagaattaatgtgccaatatgattcaaccaaaagggaagaaagaatttagttaaaaacaacagtgaggtgttcaatgaatgcctgaattcaatacattcagcactttgctttattccccttgatttgtggagttgccgccacccttgaccctttgggcctcggtcccaatctctttcccagattctcctctgaattacctgagggccagtggctcaagtccagcttgatctttctcacttttatgatcctctgtaaaccaaatttagaaagagacgataagaaattaggctggtcccacttcccgcattacaaatgcaggagcctatctggagacagagtagtgagcatttcatgtgtgcatccagaacagttattctgggatacctcagcttgtgtctctagagaagtgaccccactgtccctgacctgccggtcaccatgatgacttcctctgccctaaatcagggtaaaacatttataatgtcttttgttccattaatcatgaggcccttgcccagctgccctgcgggacactccagcctccatgtcctgctgcagactagctccccaatgcatatgccccaccacagctttcatgcagaacctgcactggtctctgaggagatgacaagaagccctgccccacctctgcatctgccaccaggtggtgggctgggtggctcccaagtctgatcctactttactcccttggatagtcgctggaaattctgagtagaagaccccaataataaccaatgtagcccttgaactactgcagccagtgcctaaaccatgtataaaagagcatggcgctttatccatatgtggagtacctgcatgcacattaccatgccataaatggagacaccacaaggataaggcatttagcgagttggtggcagcatccaggccagagcttgagtcttgtagttcttggttcagggctcttcctcctataacaaagcccttccatctcatgtcccctactccctcttagcatcagagagatgctgcccctgccccacaggtcacattccattagtggtgaagtttctatagttgtaaccatggcatctccagccctgtgttttcctctccatgctccccactgagcagtcttgatcctgtattagccccaggaaatgaaatagaaacaggaccttaggataaaaagttgcagtggagatgtggtggccaccaggggctggaactgtgggggtgactgagagtattccaaagccctgtggccaacttactggtgctgagtttgctggtgagcctctctgtcagctggcttccctgggcgagttgctcccggaagctctgtcccaggtagtagtcaatgtcattgctccttaggagatcctcaaaagattttactgtatcttttgcatgccgggtgataagataacaaatacctctcccttctcgtattttttgccgtaggtaagacagttcccgggcctgatcctgaatcagggaatcatatttcctaatgcaggacagaagaggaaagagtaagtatggaaagagtggaagctaacttatggagttatgggggcttctgtagagatttctatgagaacatctctaaggaactcccccaagctgaattctggcacataagccataggaggtatttaagagtaaattctaccctgataaagtattgcattaaaaaacttagtacgggccgggcgtggtagctcacgcctgtaatcccagcactttgggaggccaaggcaggcagatcacaaggtcaggagtttgagaccagcctcgccaatatggtgaaaccctgcctctactaaaaatacaaaaaaaatgagctgagcatagtggcacatgcctgtaatcccagctactcgggaggctgaggcaggagaattgcttgaacctaggaggtggaggttgtagttagccaagacggcaccactgcactccagcctggatgacagagtgactccgtatcaaaaaaaaatttagtatgtcactgttcttcaactgttatacatgtgttaattatatgtccctagataaatcataaggtctgtgagaataaacatagttctgcattttacatcccttacagcaccagtatcacatagattcacagcagttactcaatgaataattagcatcatttcatcctaagtctagatagaacctttcatgccttctgttttaaccaccacctgatgcctgaatttcttctatgttacgatactgtggctgactacattttgcaatgatggccatcatttaaacgctcataccatcaactgatgggacccaaaacaagagaccctaagtgagaaccacccagctgagcccagtcaaaccatagaaccatgaagcataataaagtgttgtttgaagtcactaagttttagagtggttattacttagcaatagataaccaggacacaccaagatgaatgtctgtgttttcaacactaagtatcaataacacttataactatggcaaatagcattgagagcttaacatatgctaggcactattctaagcacttgtattaattcttttttttttttttccgagacagactcttgctctgtcacccaggctggagtgcagtggtgccatctcggctcactgcaacctccacctgccaggttcaagcgattctcctgcctcagcctcccgaatagctgggattacaggtgtgcaccaccatgcccagctaatctttgtatttttagtagagatggggtttcaccgtgttgggtaggctggtctcgaacacctgacctcaggtgttctacctgccttggcctcccaaagtgctgggattacaggcatgagccaccacgcctggtcagcagttgtattaattcatttaaacctaatatccaccctttgagatgggttctcttatcatcctcatttaataggtaaggacaaaggctcagaaaggttaagaaggttgcatgggtagtaagcaccagaggtaggtagtctgattccagtattactactatactataccatctttactaatatatccctaagaggaaatccctgagacccggtatctcccagatactggaacatcatcctatgccctcctggttgcctacctgtcttttctgcagacctgtatctaccatttaaatcagtgtccctgtgaatacccagacatgttctttcttccaactgcctgagctaccctacgccaagcatgaacttacacattttcaatcaagaaagtacccaaacagtgccatccttacccaggccacgaggctgatctcagctcctcagccagcttctcttctagtccattttttgggagctgggcctccagctgggatactctctggatgagactctccaggtcctttttggcctgaagccctggagagtagaaagccccagtgccatcagacagccacccctcatcctcatcagggacactatgaggtgaagacccctccaaggtgccaacagctctcagcttccagggtctttccagactagacgaataatcacttgtaactgagagggaccggacccggctcttgaggttttgaatgaccttgttggcattctgcagctgggccttcagatctttgatgtcctttcgtaggaccaagatgttttctgactttccatatacccggaactcttcctgcttccctagctggttctccaagggcttcctctcagaggaactagccagtgttgagccccggcgtccctgctcagagcacagcccctccatcaggaccatttccttgaggctgttgtgctcctcacactctgaaaaaagacaaagatgtcttcctaaataaaagttggatgtgctgttgtggccactgcctttgagaggaggcaggtttggtcatgaggacaataattactagggaaaaagttgaagtagtactttattcaaccctgacactgtactaggcattcaaatacaatatttcttatcttccttatacctacaagttaggtttcatcactttctattttactgactgggaaaccaaaacttaaagagaggtggtaaactagcttgttctagatcactcaaactagcacatggcagagccagaattcaaatcctccaatgtcctgtgttcattccacacacactggtgtttcttaagacattaacatggccttatctatttaggatggccacaagaatgtaggacaagctattactgcatgctgaaagtttaatgctctttaaattttactataatttaaaagtttattgggttacaactgtatgaaaaataggcataggaaaataaggcttcaaaaaaatatatcagcatgttaacatcagtgtattagggcagtggtagtcagaatgagaactaatccatggcattttaccagatgccaggcactgttctaaagcattttataagaatttactcatttaattgaccttagtacctgatggggtaggtagttcctttattactattttaacacatgaagaaactgggacataggaaagttttcaaactgggatttgaaccaaccagtctggccccaggatcttgtctcttaactgccacactacactgcctcaagaatgagagagattgtgtttttcttctcttctggttttcaatgtggtgggtggccctatagttgtagtctttttataatgcaaaacaaaattatttttaatttatggcttgcatgtttctaaaaccttatctggtctctaagtaggccttagtatttctataataatcagttggatagaattttatattattattgttattagcagtatgccaaaaactaattgtagaaattcaaacttatactcagcctcattttgggtaagatttctcctattaacctcctgtcctcctcttccccaatacttgtcaggtgtggaattggccaacagcatccaaatgtgacagctgactccagggaggggtgagccccacaccctgtgctcttaccaggactggtggtttcctcccgttcagcctcattctcgcttcggccacaagtctcatagcccaggtcctggaggtccacctggatctgcttgctgtcctgcttcaccaaggattcacctgcttgggaagagaagcaggtgttacagaatgtctgaatttcccacatatgccctcagcctcaatggcacataccctaaccttttgaggcacggaaggcagatccacagtgggagagaagcttctctgaactggtgggagaagagatcaccagctccaggaagcagaatttctttccaaaggaggagcctgcatttgccattatctccccttcagataacccaggctttagttgggaccagatatctgtaagtcagggattgtacactatcatctctagcagccccattgaagctggcaagtgctttatccgcaggggttcaataaatgttgaatggagctgaactaatttagagtcccaagaccctagacctgtactgtccaataaggtagttagcagccacatatggccactttatactacatcaactaaaattaaataaaaccaaatgtccaagttgcactagccacacttcgtgtgctcaataaccacgttatgtcggtatagaacatacagaacttataagacatataggctagttttctttactagtaagtcatagttacttactaagcataactctgtatttctccagctcgttagcctgagcaaagacagtggcttctgatagcagcagcttctcctggagatcttgatagcgttgtttgcattgtgacagctgggagcgcaggtgctgggtggaccctggtaggctaaacgctgactgaggcccagggtcacgaggctgggactggttatccaactgtgaaaggggccaatacagggatcaggacagtctgaggtcacccccatgcagtgacgaccaccgccccttctgaaccctgtggactttactcaagtctgtcacagcacttctcatgccatttggcagtgacttgctttccagatggagctcctggagcgctgggataatgttttcttcatatctgtatccacagcacacagcacagcaccaatcaagtctacagaggagctctcaggaaatgttttctcagtggtcaaaaagagaccactcatctcccctcacattctgtcccattgattctctcagaatccctgtattctccatttcactgaatcttcagcatggctccttccctaaagaggatcccagtaacccatctgaagcccaggaacagacacctgtgatgagctgtgacaaaaaaatggcagtgataagggatgtcattacataccacttgtctgggctgcctcataacctgatgcatccctatgttacagcagttaccacatcctgttaaaattacctgtttgtgtgccatctttcccgacaatattaagtatctcaggggcagccattggttttattgccccatgccaatgcctagtgtgttatctgaaaaattaagtactcaagaaatatttatgttataaaagcctttctaaaggctgaatgtaggcagaatattactattattgtttgtggtacaaagagacccttctcttggtacctcctgattcatatgggagaatgttttaaggtaaacactgtcatctcaagcccttctccaattgtttttcactcaatctaagcccacacttacttggtgggcatccactgtgaaggtagccccaaggtcaaggctctggggtctggggaaaggcctcacagtcacattcccctcctcttggtgttggtgcttcccaggggaaccaaccagttctgtgtttattctttcaatggtgctggtcagatgcacaaggagctctggagtaagtttactattcccttccttgctactcagcacaagttgttctttgaggaggttgatgatattgtgggcattcttcagttttccctggagctttctgaactcagcctgaaggctactctcactcagaccctctttggttaccacagtctcaaccatcacctcgcccttctccttgtcttcctcgatctcccatccatcagacattgcttctcccatctgctctttcagctccgcattctcaaggcaaaggctcagcatggtgttcctgcaggaaacacacttaattgagggctaggtctggtcctcacaacagttcctaatactacctcttaccaacatctcagcccgcaattaactcagacttaccccagagcatgaagcaacctgagacctaccacagccccctaattttatatacaagaaagccaaggctcaggaaaagtaagagacttgcccaaacttccacagcttcttggtggcagcaccatcactagaaaccttggactcaagacatgcaggctagttttctttacttgtgccccatagcctcatatgttctaatttttagtagcctctggaataaaccagagtacttacactgttaaaaaataagaccttttctgtaacaaatttattgttataaattttacagttctattatttatcatcagtcagtttcaaaccattgggacttaggaacacagaataaataaataacactaatcagaactattaatataatcaaaatgtacttagataattgtttgctttatgtctggctcacgtgatagagataaccttcttgagagcaggactgtgtctgtcctattcatcccatatccccagtgcctacacaagtgcctgccacataaatcattcatatttgttgaagaaataaaattgaccaaaacagctaatttgcaccaagacattccagataaattctttccacaacaacaaactcatactagggttgagtggaagcaaacatggctgtaacaagtctattcacttaacttttttgagcctcagtttccttttatataaaataaggatgataacacttacctagtagagttagcagatgcttaaatgaaattgcatatacggtatggctagctcagggtctaacagggaagtcattcaatccctgctgtactagctgcagacctaagaaataccaacagcagaatcccataaggtgcttgtttaaaaagctgtagagctaaggcctatgaatccacattttacttaagttccacaggtgattttttaatttttatttatttattttttttttttgagacagagtctcactctgtcacccaggctggagtgcagtggtgagatcttggctcactgcaacctccacccctgggttcaagcaattctgctgcctcagcctcccgagtagctgggactacaggcacgtgccaccacgcccagctaacttttgtatttttagcagcgaaggggtttcaccatgttgggcaggctggtctcgaactcctgacctcaggtgatccgcctaccttggcctcccaaagtgttgagattacaggcatgagccaccatgcccagtccacaggtgattcttaagcatgctaaactgagaacccctgagctagaggatgcacaggaaatgggtaattcacaacttgaaggatcagcagtgggctatgcacctagattgaatttctcagaatccaggagtcttggaacctacagcagagcttatctggtgtgtttctgggaggaaaataggacataggatacagacaatctgtgagatagtttctcaataaagaaaaaggggataggtattttaccaaaactgggatgtggaaaggggataaagagggcgcatgtgtatatggaaaagaatatttaatattatgttctaacttcatattaaaaaaaactgatatttttaaatacaaacaaataaaagaaaaactcaacaaaaccttcttgaaaggaagaacaatgcattagattctaccttctacagtataagtgattctgtaggttgggtggagggttgaacaaatcagagtttcaggttagtaattctgaggacaaaggaaaataatccacagggatagctatagatggtttgattgtaggttcaacaatagaatcaaaagagatgtactgttcttacccatgacaactcaattaagtttacacatacaaaaatttaagtaaaataatatgctttaagtagaacttaaggaaaaagttattatgataattcagagcaaaagaatcagcacttagaacaatcacaagaattttttaaaaattgtttgacaaagtatgtagtatagaagcaaggtttagacgttagaaattgggagccacagatattatgcaaccttgagcaagtcacttgaaactttctaggcctgagtttcctcagctatgaaacaacgacatgaggctagatgcctgggcccttttcaaagtgctaacattattcagggaaatttaagtggtatgtaacatgcagggaaacaacagggcatgatttagaagtcatacagctgtactttaaacaggcagtgatgattatagtcctgggagtgaatgaataaatggatcagccctacagtatcagcatgttctccaaggagcttttgacaaaaagccatcaaagacagagtggccaatctaaccaatcaatgagctacctgctatttttgtaaaattactaaagcagcagagatgattaaaattgatactctatgattgaaggacttatgagtgagagctgagaggagagggaggggcctctacacaaaccctccagccgggtgcggtggctcactcctgtaatcccagcactttgggaggctgaggcggggggatcacgagttcaggagattgagaccatcctggctaacatggtgaaaccccgtctctactaaaaatacaaaaagaaaaaattagacgggcgtggtggcgggctcccatagtcccagctactcggcaggctgaggcaggagaatggcatgaacccgagaggtggagcttgcagtcagtgagccaagatcttgccactgcactccagcctgggcgacagagcgagattctatctcaacgaaaaaaaaaaaaaaaaattcctcctccttcgtgaactgttctggttctgtatacagcagtgagacatattaggtagcagggattccttatacgttttggtcaattaaaaacagcaatactggtcatgtaacaaggaggtttccaccatgactgtcatatgtatgactggcagatgcacaataatagtgggcactgttatactgaattaagaccaggattatttgaataacagaaagtgattaccattagccaatattacttacttttatctaaagaatttgtagaaatattaatgcatggagcctgggataggcaccccttggctgtggtgcctcatgacctgcaagctccccttccctgggaagaatgtcctacctgatgtgggacactgaggagaatcctgcttcctcaatttgagcctttagctccttcagttcctcctcagctttcctcttctcttctaagtgctggtggaactcagccctcaggtggagcatttcttcctgaagacacctgttactgtcccctcccatcggagaaggaggggaaaaagatgggttctgggtctccacagttgccagacttttctccaaagccaccttgacaagctaaaagaaaatcatggtttgaagaagttaggccattaaagaggacccaagagaaacatgagattgcaaaggcagttttaaatgagaacaaaaacaaacaaaaaaagcagatctaaaataaactccctaaccagaacctccttagtcaggcataagggccctggggactggtttgggtgggaaggacacacaaaatgagcaggaggaatttccccatggagaagaggagaatccagagatggtgagggagaaaagcacataagaaattaaaacaaatgcaaacaaacgaggttgaaacaggactggagggtgtgaatacggtgattctttctcttcctgaggagacagagccctgcgagttttctcacaattcaggaagcttcatcagctctgcaacacttgagtcctggatggcgggagatgatggcttaagatatcagggcgcaaagcctaaggccctgcctgtaactccaactccctcaaggacagctgagagggaggactcagggcactggggaaacagtcggcagacacagttacagaattagaataaggtggagcgacagggaagacaacaccaactatttcattggcagcagaaggatcacactccgcagctactgggagatggaggtgaagccatcctgccaagcagccaacctcactttttggttattatctttgtgctgatgctgccagacaaactctctctacaaatctcagcatgtggaagaaacagaggcaggaacaactgcccagcacctttctatttcttgaggacactcttgaagttattcatcaatgttttaattaaagcagatcttatggcctttgctcaaatgggaatttgttaacttttagactttgttattgttcattttgggcttatctttggtcttttcccacgctcttaaaagtgtagaaatcaaaatctgagtatgataatctacttagcatatgactaattactttagtacaaggagttcctgcctgtctgtccaatattaatcttaatatgtcccaatgtcacattggcttctttttcttctcagtggcagcatttggagcttttacttaactttgggtcaattttggcctctgaattttccacccctcccccacagctgttgctgagtcatgttgttttcttttatctctacaaatattgtgacttgtaattgtcacttataaattcattctggctatactgaatcattccccaattatccaagtcatccaaatatttgatgtgcatttccacaaatcatgtagtggcccccactacaagtgattggggataacttgtagaattaattatatgctttatatctccattcaggtcaccaatacattgaagagagcagggcccagaacagcttatatggatcaacgactgacagagctgctggggttggtgcgaagccactgacttttgctattccccgtaacaaagtatgttcaaatgtaggtcacaggtttgtggtagggtcgattcacagtatgcatgtgcaatggtgttcagtagcatagcagttgaggttgtgaagacatgcgcacccaggtcaaagaagaaagatccttagacaaagccactcaagtcccaggcacccaatcttacttggactttgtgagcctgagatttgggaggctcctgggaatgtctgtctctaagactctgctggcaggcttaatcaggctggtggccatctccatatgtgcccccagcatttgtgacaaaataaaggaagggggaccaaataaaaccacttctgaaagcttacaatcccatcccttatttaaactatgtgatgttgtcattctatataaactctttccgagtaacttaactaaaacacactttgccattagtcttgagtgtgggcacagcattattcttttctaggccttaagggttccttctgcttaaaaataatgtctaactttaatgaagtttacccattattaaagtgccttctggatatatgttatcttgttctattggtttcaatacacctattttctttaaaaagaaaaaattatggaccatgaatgttaacaccagaaaaaccttaaggtacatctgatctaatttcccactttaaagtgagaaaatcaaacattgcctagggatctcatttttccccaggctaatttgggttttcatatttccatctcaaagtggactttctttggctaactttaaggtttttttttttttacatatatacaacttttattttttatttctttttttattttttatttttttattttattattattatactttaagttttagggtacatgtgcataatgtgcagcacagcatggcacatgtatacatatgtaactttaagttttaaatgtaaatgcctgaaaagtaactcaggatctagccttttcattagttttgatcatgtatgaaagcaagtatttctttcccccaaatgaaaccccagggcttccagtatttgtagtgatagtgtgaatccattaggtctatttttaattatatctgtcttattggtttttttttccacatttcctaactcacttgtgatattgcttcatataattcaactttttgtgtgctgggttcccatctgccccacaaaggcctctgtgcaaatctgatatcctgtttgaatgacattgttttgcttttaccctattgcttcgtatctgtcccaatgttaagtcagttctcaacattaaggcattaaaaattagcttttctcaaatgctcagcatcactaatcattagggaaatgcaaattacaaccataatgaatatcatctcacacctgttggagtggcatttatcaaaaaggtgaatgatatgttagagataatgcagaggaaacggaacacagacattgtgaataggtatgtaaattagtacagctggtgtggaaaacagtatggagtttcctcaaaaacctaaaaatagaatctaccctatgatccagtaatcccatttctgggtatatatccaagggaactgaaatgaatatgttaaaggtatatctgcactctcatgttcattacagcattattcataatttatgttaagatgtagagccaacctaggtccatcagtagataaatgggtaaagaaaatgtggcagataatacacaatggaatactatttaaccttaaaatgttgggggagagctcctgtcatttgtgacaacatgaatgaatctgaaggtcattatgcttagtgaaataagccaggcacacataccacataggctcacctatatgtggaatctaatgaagttgaactcatagaagcaaagagtagaatggtggttactagaggctggtggagtggggagggagagtagggggaattgttgatcaaaagtattgacaaaaagaataggtcttaagatatattgcatagcagggtgactatagccaataaaatgtatatttcaaaataagagtaaattttcaatgtttcaccatcaaaaatggtaggtaggtaagtttatgaatatgtaattagcttggtttaatcattccatattgtttgtgtgtatatatatatatataatcatataccccataaatgtatacaattacgatttgtcaatcaaaaataactatttttttaaaatagcttttttcaagtttatcacactttgtctactaacgtctgttcttcatatttgaatcttgattttttttctttaagaggtaggggtctcattatgttgcccaggctggccctgaactcctgggctcaagagattctcttgcctcagcctcctgagtagctgcaactatagatgcacactacctgggcctgaatctttattcttgattaactttttctccattacaaaacttcacataaaaaatgcaatggttgattactctagtttctttcacagcaatttcataggtatttattatagatcttacatctgcttgagaatagaattttgtgggagataatctagggaaaattactatcatggccagacttgaggcttcctgaggtggctgagtccaaaacataaggagcaagcaacttgtattggccaaaaggtgattctcaccttggaagaaagacaaggtgggatgtgtctgttaggaaaagcatatgaatgcttggagtaggaagggaacttggtgtcaggcaaaaatttaccttccaaggacataacaaggagaagctcaaaatctacctttaagggaccattttcctggaaacaagcaaacaaattttgagaatctggacacaaaacagttatggcaaagtaagctttatttaattggtagcaggagagtcacaacttcaaactccagaaaagatgaagtaaatttgcaatgatttcatacaccaagattcctcctacccaaagctgaagatatattttcaaggaaaggtgatggaaagaaaaatggtgctcgcccaagagattcttccatccagcaggcatatactttgtctatcatgagtcaagccctgatccaaaggcttgttaacttataattacactaagcatctctcctatgccaagtaatgtggcaagtattgtgagggaaatacaaatgccctaatgtaaaaagttcattccagtgtaggctgaccttctcaaaatggggtctggtcagattctccatgctaggctacaggaaagaaggctgaagaagcaaatttacaaatcagtttgcctacaattgagaattagagcaaatgacttgcaataccaggagtacttcagaccatatcaatcagaaactttcttcatatctgtgtctcctgttcatttattctgaagttaatcctgtcccacagtcattataaccatcagtgaccagccaacctcccaatctagctgtcttagagtagacatttgttcatcctgcaggtccctctctctcacccaagatcctcaatgaaatcagagagtgaggacagagggatctgtctggagggacagagatgtatataattaaagtcacaaccatcggtaaggaggactcaggagaagctgttcaagcaaaaggaaaagtggagctcatgcaagcactcaagggagaagggaaggtcgggtacagctatagcaacaagaaggtgatcctattataagaaggtgatcctactactacaaagaaactgttgagaatatgacgtatcccagacaactactcatgtccccaagtgccaaatcccaaaagatttgaggatgcttatttgggctcttcttattggttgattcgatgtctcttctttgtcttatgcagaagacatacaggcagacccagaaagcctcatttcttgtttaattttcctaatagccccaagaaagctattactggaaagtccagctgcttgtgcaggatatctaccaatgattcactttctccttaagaatcataggcacagtccatttaggagatgagattgctaaatggcatggacaaagtggagacattataggagttccggtgagtgcttgtgagatcactattggtgacttaatctctgaagtccagattattcactcttgtaacatgctagttacatcttcactgatggtgggtggaagcaatgtttcagcctcaagttctgaggtttgacaggggattgctgttgaagtaccatctgctgatcactgagtcaccatgacctcagtggtttgtcaggttgcataaggttctctttgtataatgagatttcactgagaaagattcttgctttggaagcattccaatcttcttggagtttcttcccaagcaggtcctccgccctgccacctccccgagcagcccttcgatgactccctgtcttctgtggtgcgtttcagttacaaaaagcccaaggggaatgtgtccatcgtcttgcaagtaaaaatgcttctgaagctatagctacagagaataaataggggcaaaggtgggtaggagggggaaggaagcagaagaaagagatacaatacaaaccaaagggtggattggagagaaaaatggagtgaagatatgggttggaaaggcagctgggaagttcaaggagaacaggaagatgactgagaagtagtttatgtaaaaagatatcttctcactaagtccgcaagggctgcaggagactatcagacctcagaagggctgtgtgctgtccaccctggaagtcccagaccctgacactgacttacttgctggtgactatggtgtgcagcctcctcctcaatactgtcagtgaactcagtgcttgtatcttcggtgtcatcccctgcagctgcacctggaaacaagtccagaaaagaaaagtgattcccttcacagatggcttccagacagcaggttaaattatactctttttgcccgctgactctgatttcttcctttctccatatacatggggcagaaattctccctagccagcagggctggaaagaaaaatagaactttttgtatcacagacactttcttactcatactccagcctgagcctcacaacataagctgactttgcctgcacagacccatttctaaggagccgactgtcggatgcactggttaccccactcgaatgtcaagaaagcctgaattattccccactgcctggctacataaaaactttctcttccataatatgagtccaacatgcttaaccctttccccaccactgagtgcctggagattagagctgccctgaatctctcagaggtatctattgttgggatcagttgtgcatagggtgacaatctctctgaggaacttccctctgggggtcctgtgtcctagtaaggttcaggtctagtcaagattcaagacaccaaaggattcagttgttccctaatttcttcctctaacctcccttcctcctcacctctctcaaactcttattctatgcagacaccctttgcctgaagggtttcttgcactgctttatccccgtgggatttaacccatcctttcattctccagagatggacacagccactctagggcccaaacatctacaccttgctctaaggtacaagtagctgcagtttgtggtatgggcaaaggtctaaggcagcactgaccaagaggactttctgcaatgacagcaatgttctgtgccagtgttgcccagtacagtggacacagtcatatatggctattgagctttgaaatgtgggtagtatggctcacatttcaaagcattgaatcttaaattttatttaaatttacttatatttaaatgactgcatgtggctagtggctaccctattggacagcacaaatctagggtgtgtcttcctccttatattgattaaaattaagactgttcatacattttaagaccaagagctatgttttatatactgtatttttcaggaagtgtagaaatttattatggttaatttgtcaaagaaaatttactgtgacactcactgtgtcttatagaacctccccaacttaagaatcttgaaatcttgttctgatcctagcctcggcaaccaaccagttacaactccacttctgaccactgattaacctggacctctaagagattacgtggtgagtccaaggttacacaactagccctcactagagctgcgccagtaagtcaagactctggactcttagacagaagccactcacttttccttctggtgacaaatctgatctttatctttgcttcttcctccaagaccaaagaaccttctgttgagttcagacatccaggcatgaaaggctctgcttgaatcatgagcattcactacccaatacagataaggggcttaccttatctccgtaaggaattcgacggagacaaataaatgctcatctcatctcgacactgccacacaggggttttgtttcttccccttcattctctcttttttaagctagctcacagtcttcttccattatggcagctttaagggttgctcagccttttaccaatttgaattaaaatgctgaaactttttctcccatgtttgagggggcagttcacatctatatatttgcaatggcccaggctgatctcatggaagtgctaagaggtagtaagtatgctgtgataacagcttaggtttcctcatctacaccatgaactttatgttaactttggatcaaggaagggtcctgttcagtgaagcctctaccacctctaccacttagcatctttagaggtctgtggcagacagtgtacaagagttatttccaatacttactcattcaaaccaaccccagaaaccatctcactcaggatactagctgagtagaggtgtatggacacattccctaatctttggctgctttaaaaacttactgaaaaccaggatactaatttacctaggacacccacatcatgttatgcttactttggaaaatctttccctgtacaacagtagcgatcacaatcttttatgtttttccagcaaaggaaatgaattgtctcactcagtgacagaaaacagactgttcacattgtttctcttttgaacatggggctagagaaggatcctgtagttgaagaaagcacagctctatgaggtcaggatcctcatcccctaccattgttgctgggttgtggagtcaggctgggcccacatcccaggaccattcctgccaggttccagaagcgagaattggaaagggtgactatcactggtcttgaaggtttttatctgacactttctgccctccacttatctttggcagcctttctggtgccacgtctgcattcttggataatgctccatcttatttcacttaagagcaggatgctatggttctggcttcataaggaattcgacggagacaaataaatgctcatctcatctcgacactctgccacacaggggttttgtttcttccccttcattctctcttttttaagctagctcacagtcttcttccattatggcagctttaagggttgctcagccttttaccaatttgaattaaaatgctgaaactttttctcccatgtttgaggggtaaagctaaaaaatttatagaaaatatgggaataaaagagtaagttatctcatacaaggtccatacaagacattagacatcttttaccattttccatttttttaaataaatgagagaacttctcttgtgtgatacccttttctaaacttttactgcacaacgaaacactgtcttcagaactaacttggaatattttgaatttctaatttaaggtacctatgattttatattgatgactcgtctgcttattttttgataaaatataaaatagcctgccgcctttagattctctgggagctaagaatctgttcatttaacttgcttcttcgagattaagttttacatgttagactggcaattttataaaaaacttttatttgaggcttcaataaaagttctcaacttgtggttcttggaagtttctaggctctgaacaatacaaaatggaggtgataccaagatgtcccttatttagaaaagtattttctatcagctatctaattctacaaagtacacaaaaataaacctctaaaacataagaccataaaatccttgggtgaaaatgtaagcgttatgcaaatataaggtattcttatcactgaagcaaaaattcatacttttgtagaactttttaaattgagtatggcataataattaagaacaagaactatggagatagactgtcttgatttgaattgtgcttttattgttagttatgtcacttcaggcaagtcataacctttccataactaagtttcttcatttaataattagggttaagagtgttacccactccatactgttgtgaactttaaagggtttgctgattttgaagtgcttagaacagtgcttggtacacagtgtgtactcaataaataccatccttaaacaatattattattgttattgtaagtaaactgaagtagtccatgggcttataagttgaagactgagaaagttgaaggccacagaacctaaatagcatcagcagaaggaagttttatacttgatgttactatctgaatgatcttgattgattctacctgcacttcttcatttctgaatacttgtttccccagcaggaggcttgaaatgacactctttgctctctgcctcacaggacattgaaaaggtaaggagtgacaactctttggctgaactctttggaataggtgccttacaaaaaggactaatcatcattaaatgataactgtcttaaaactccaacatgcacaaataagccttagggggaacttcatgacctctttttttgttttattttgctttacagatgaggtctcattatgttgcccaggttggtcttgaactgctgggctcaagggatcttcccacctcagcctccaagtaactgtgactacaggtgcatgccaccacacctggctcatgacatgttctttagtaatgagtccaaactgggtggagtcaagaccatttccccccaattctactctgtagtcattatcttcctttaagccactaatatgggataaacagaaaaggagtgatgtttttccatatagttacttagaacatagcaagagatcatattttattaattttaaaaggtgatctgaagaactaaaactttaagcatgaataagttggcagtgccaagtgttctttccttcggtaccgggcccttgtgtctaatactctcagcccaatttcactctgactcccaggtacactgccatgcgttcattacaagaacgctcacattttcacgtcatgaaccaactattgctgactttaatgttatggtgctgtaatgttatggagagaatcaaggaaaagaggcctcctatcaaactacaatttcacctgcacacattcccttcaggatcataagaaaactattaagattccatatagtcctccatagtttctgctaagaaataaaattctctatctagacagattctgatcgtggaacagaagtggtagaaaactgctgtctgcagtcaaacccctttatggtgtatctttgtctttaaattgcaacatctcttaagtagccttagggctttccagctcacatgtttcagaaagtagctgttttaagttacttgaaaaggccaaatcataatctaaaatacttttgggggtatgaaatcccattaaaattctggaaagagtttctacttctccaaaagggtaattattcaatacaactacagtcttctatccttaggctaaccaaggcacatgtaaattaggactcccaggcagaccaggagatatgaccactgcacctattttgtgatgccataattctgtaatgtcaagaaattcttcctgctcatggtctcttttattcttcaaagaaaacgagaaataggtttttctaggaatgtttagagacagcactacccaccacagttggctcctgaaacctctgtcgtgctttctgctattctcctacagcaaagaaagcaaggagggtttttaaggtaaagtagcctatgtgacatttccggggaaagtataacactgtttctttagtctcacttcttcgagaggagaaaaattcgagtttcttcttccttcctttagttaaagactcattctacgagccttgctttgacttggaatttagtaaataatcaatagactgattctcccataaggaaaaaaaagatacaagctttctctactttttttataaatatcttaagaataaaaccaaatagtttctgttggcctttgataattttattggatcagtaacaactttttgtgtttcaactaagatagctaaaattctaacacttatatgtaaaaattacactccattttagcacaaatgttaacagaaattaacagcacagtgccatgaagaaatgaaaaatacacagctttggtagggaaatggtcctggaaataatgtaatgccaagtttctgatcatttaacatatcactcacctccttcttcatctgatgttatgaaccactttatttatttatttaagacagagtttcactcttgttgcccaggctggagtgcaatggcatgatctcggctcactgcaacctccacctcccaggttcaagcgtgaagttatgaatcactttaattcttcttaacaacccacaaaagtttaagtgaaaactagtaagacttcatggacacagatagaaactcataatttataaaacatgctggtataaatgcatgcctacaaaggttatagattgagaaagaggtcaatatcttggagctatgactttgattattgtaaaaagaagcactacatattcatgttatatactaaaagtaaacctacaaggaagccaatatggtttatgtacttaaaacccctattctccatattattttaaatacaacattttctgatgttgctgaactttctattttacccttccagttttagtaagaggaaaacagtatgataaagatttttacttctggaatttgactttaaacaaaaaaaagggagagtaacacaaaaataatcagtatatcactttataagtttaattattcttatttgaaaacgggtagaattagtattgtcaggaccacagttttgtgttcccttccatttcccattctttgttggagacaaattacaaagctattttttatttagaaaattgatcttggcccaggtgagaacagggagaagttgaagacttaccttctgttaatacttagattacttaaaagcaacaggcttgttatttgatcataataaaatgttttaacaaagctactggtgcaaagggtgagaaggtggcttaaatccacattctaaaacacattataactgaaataactgaaatatacactatataaaaaacattataactgaaatatacagaaatcactcgaatatattatcctactgactcattccttctgtttattactgtattgccacattggagttccatatttccagctattctttctacggtacaaatggttccacactaccaaagagaaaagaaaagctcactgagctttaaccctgagagaactcagagaaaatactctgtgctggtatctcacaggatatacctggaaaagaaaactaatttcatttgttctatctctagtacaatttctacaaggtaaaatggaaaactcacttcaagtgtgtgggttactaatatttcttcctaacttcacaggaagtttgtcacctttccttgcaggatactgactgtaaacctgcagaatactacatgataccctacttgaaaaggccacttgagcttttcagggatgccaaatgtcaagattttgtgactgttttctataaaaagaccatgaaacgagaaaacaagtttatcctatcaatgggaactagagttttctaatactacctcaagaaaagcaaaggtattattgttctctctaaggcttacagtccaaaggaaagtgactttaggtagctcagtcaacctttatttctcaatgaaaaggacaattttcagtataatgtgatctgctactcctttccacaatcagaagactccagattcaactggaagatcaacatagagagaactgaaatcagtcttcttgaacagtttttgaagctatgaaccaaacatctcatgacccagacactgaattaggaggatgaatgagcataaaagtgataggtttttttatgtacatcggccacagagtttacttatgcataaactgtgtaaatagaatatactaaagaaccctcaaggaaactaattcttatgatgaggaactcatatcctctacaggttaagattttctggatccttaatagatctcttgctatatataatgtaatagaaacatcttttaaaaatataaataaggaaaaatgtatttcctctaagaagcaaaggtcctgaaaaaattactgctgtccacaactgaatgaagagaagagggtgtggagaaggttgggtgacagataagagtacacactatcaaaggaaaaggctgacctactaacttagtccaataatgtcttttcaaaaaagttataacttggctatctaaaaagagaacatcagatgaatgttgatttatactaggtactaataatcatcaaattttcaatactataaactttcaatagaaaagagtttagggacaatatctatctaaggacatttatttcactcattaaataagtcctcttggaggttcttttcaactctatacttctaaaacctacagacttcatctaccctgaactcttagaaccattactctgcattatttgctattattcaaaagggaagcatgagaaaaacaaaatctatcatatggatttttttctcaatttaagttctatgcttccaattaagcatggcctaagtaaaaatttacttcattatttttatttgaagactatttttactcaagcacaggttctataagcacacgatgctttatttaaaattactgtcattgaaaaatgactgtcaaaggtaaaataatccagtatgagaaagagtctgtgctcctgtagagaaaatggaatattatatcatgctaaatattattaaatgatgtgtccaaccacagcatgatctctgtgtggattataaaatttatcagactcatgctctctaatcagatgccaaattatcacacaaagttgttagaccagcaagctctctccagataacactgtttgcaagcctcattccagctatctagacccgaaaaagttagtaccatattctagtcacatttatgacattaagatcagacttttaatttatcctgctatcaatttactcttgctggaggttgacagaagtaggagtgattattaacataaactgtaatcactatgagccattagaaatgaagaatcacccagagctgaatcttactagcgattcagaaggcttccttggttggtctattagtaaaattaaggaaagatgttccctaaatgccttgttgtaatgacacgacaaactagtctttgatgggttgacatttctacggctccattaccttcctctttacttatggaaagttacaaaaaattttgtgcaagaaagggtctcttaaaattgggagactaagaaaagtggatggatcggcctacacttcctatctccttccttaaatgactcctttttcctcaaaagccattgaaactgaaatggcagatccattaagagtaaggcttatggctattaatcttttgcaaatgacttaatcagaagattccagagtgcttccccagtagagcattttctccctgtccactctagtttgactgatgctctatctgttatagacacagctaaagttacagaaacagatgaaatttagaatgtaatacaagccatgtcaacatgtgaaagaaataaagtgtcatgtaaaaaaaaaatggaaggaaaaaaaatcattgtgccccacttagtttagaaagggtattcagtcacatttactgtgctagaaagcctcaatccctgttcccaaattccatatttaaagtaactgaaacctcagcttctaacctaggaaacttccaaccagaggaaatgaaaacaaattcatgatgttgatctcacaaagctgcaaagcaatcttggttacttttcacacttgacattcaagacatcagaaatacaatctccagtgcccctctccttatacctgtcacgctgccacaagaaagcactgaggcaatgattaaaactataaacatacatctgtaacatttctttctaaactattctagcacttcaaagcctgaagcctattactgttatatggagaaatgtatacatactaaatagtgaaaaacataggaccctatctagtgccacaaatgaaagaagcaataccctcttctggctataatgagttatttggtgaaacactgaatgtaaagagggatactacatttgaaattatctttgtaaacagagaattctgactctggaagaccattctagaagtcatgttctgactaaatagcatgagcttggtttaaagaaacctaaaggaatcaataaagaacaaattttaagtagaatttaatctgtacctaatctaatttcacttgtgtacaacagtcaactctgagacagtattggagataaaagttgactatgatcactttcatagttcttgcctctgttctttaacttggccttcccaatacttgcagtctactattacaagactactctcctggttttgattaccttctgataaggattatatcacttttgcaaagtcattcttatagactctcaatctctttcccgctctctcatcttaaaacttgcatgcttttgatttaaaaaatgctctcactcaaagaggagttgactgaatggcaaaaataatacacacacatgcatttatgatatgatatggaacatatgaaatggattgtgaaagttggggaagaataaactttattggcccacagaagggatgagggaacgagaaggggctagggataagaatgaataaaagtggaaaaactaaaacagaatgatttaaaatgtgcaaatacactttgcaacctccaccattcaatttagggattgatatgtatgtacagtgagatccatgtaggctaaagtgagtttcactttgtagttgatgctacttgtaccagttctatcattagtaagtcaccgtttaattctgccaaaatcagacaaggatctttctggttagtgcaaacaaggttttccatcctgggctgcagtctgacccgccagtgctcagtaggcatgcttgtgatgaattcgcacactttccagttccccacctccaatggcggccagggtctccagcctgtttaagcgctccaagcttcttccaagaacttcttctagccgactgcgtaacacctgagccccttccagttccacctgcagagttcggtctctctcagagctgattaaacatgccacatggaaggaaagtggattagccatcaactgtagtgagtccacatttgtttccaaagaaccatcaataccactttgagccacacgactttgtaaagtaattgttctccaggacacaataaatgaatgtagtctttgtgtggcatttgtgttcactgctgatagattagtaaggactgttgctttttttaaaagcttgccccttatgctagattctgggccaatttcacataaaattatagctcctaagacttatctcacacccctatagcccaaacaagagaaatttcattatttggctaaaagcttttgtttctgaaaaactaaaacccaggacaaactaaatataaactggagcaagactgagccaagtagaaccactactgaagatatttgttttctcatttgttaccaaacttgacggtgggatggtgtgctgaaaaggaatctggttcataaaaactaaagctccagaggttctttaaaaagtaacacaatcaactggtcctatcatacctttcctctgccttcattttcctggtagaaagaaaacatttttaaagcccaacaataaattacaagaaactgaatagcaaaaataataataataataaaaattgaaaaagaataaaaggggctagtagggaaggcaaaatgagaaaacaaaaatgaagagaatataaaatgatccagagaggtatcatatatgtgaccaaaaatcaagaggtagaagaaaaatatattcatcatgatagctattggtggtcccaggatgatattagccatcccaattaatatattttctttgatgatattaaatgaatatcagtgcccattatagccttactctttttctttttttttgagacggagtctcgctctgttgcccaggatggagtgcagtggtgtgaacccagctcactgcaacctctgcctcccaggttcaagtgtgtctcctgcctcagcttcccgagtagctgggactacaggcgcgcgctacctcacccagctaatttttgtatttttagtagagacagggcatagccttacgtttataatagaacagcctttaacaggacatggatcacagaaaagaaatgaacatacattgagtgcttactacatgcaaggcattgttttagacacaaaagctgtcttcttatttaatctctgcaatagctgtgtgaaacaggcactaatcccaacttaagattttgacactgaggctcagagcaatccataaaacaaatgacaaagtgggtagccccggtaattgtccctcttttttctcccctcttcagtatcataagcatctgcacttaatgaagaataaaaggcataaatacaatagtaaaagaaataaaaatttcaataaagaataaaagaaaaaacagcctctctcttacctctctggatgggcatggaacttcaccagactgctatagagctgtctctctgcttgtaaggcctcattgagccgactccgttcatctactagtccttctagcatcagcagcaactgagtaaagaagagagaggaagcaatacgcaaatggcacagtgagacatgaataagaaacaagaaaatgcattagcatgtactatgacttaaaaagcccactatcttagtacttaagcttttgatactattttatagttttcaaatcaatgtcatattatcttttttttatctttaaaacctgtaaggtggaattcaaacatgggagcaaaaagaagaaaaagcagagagaagctggaagcacaggaaagcagctaagaaaaaggagtaagagggaaacaggatggacaagagggaaatgtatataataggacttactagtattcttcattcattcaattaatatttactgagcacgttctacgggacagactctgttctaggttctaggggaaagcttactatctagtggaggaaaaagacattcattaatcatagatgtgtgtcattgtgagtgtaataagtgctataaagataatgagctatgacaatgtataatcaacagagttgtttaaggtacagttaaaagccagaatgcagtggggtgagtagttagtgagacagatgataatggagacagggagtacaggcaagtaagtcttttggaaaagtctggcattgaagaaaggttaaatggggctgtagctacagagaaatttggggcaaatgtaggggtttctttctcttttttttttttttttaactgggagagatctgaacatggttaaatgcagataaaagagaaagattcagttgagggaggtgacttaggtatgagtgtgagggataactattggtatgtgtccaaaagaactgctgctcttttcagaactacaaatgtcagaaaggggcatctatagctgctaccgaccaaagtaggaaattttagagcacagtttctctaggaaataccatcaactaaccctccacaaatagctgagattgacagctttaccatggtttatttcacagtagaaaaataaggtttgagccgggcgtggtggtgtgcacctgcagctccagctactcaggaggctgaggcaggaagattccttgagccccagagtttgaggctgcagtgagctgtgatcataccactgcactcctgcctgggtgacacagtgagaccttgtctcaatgtggtgactcatgcttgtatgtaattccagcactttgaggggccgaggaggatggatcacttgcagtcaggagttcaagactagcctgaccaacatggtgaaactccatctctactaaaaaaaaaaaaaagaatacaaaaaaatgtaaataaataaataaggtttatattccagtaacttacctgttgtcttcggtttcctgaaatttcttgaccctgggattctactgaagcaactttttcccgaagaagtaagacttcctgggtcaggcgttccatagctggtatgtcttcaggatcaaccagttgcatttgcaggtcctagaagtcaaaaaataagtatggatgtgaaaatagtaataaaaggattattcagcagagtagcacgggaacaaatgtcttgaaatattctgcctatactttcaagtgggatatggataatcactggccaagggattcgatgtgtgcaaatattgtctgaagaggccctacaggtattctgagctgtgaacatttccagtggtctttaaaaagttttgaaagacctttatgagatcttctttaatctgtatgttcctggtcagagactccatatcagcagcctgcacctgcagctcttcttcctgcacagccatcatggactgtagagcagaaagttccatctgtgaaaagaggaaacaatgtctgccatgtttacattttaacactgaggcaaatgcttttgcatatcctattactatcagccagtaatggaaaagaaaatgagaacatgaatagggctctacagcatcaaaccaataatccatgcagtatagtaacaaaggaagttttatgggaagatgtcatagttgttcttaatgatgtcttctactttagctggcactataaaacacatcaaatttgtttaacaagcttattatgatactgaaaaagaatggttaccattagcagaagcaagaagagatgaagtttttatgtaagtaaaacttcacctaacagatgaaaaaatgatagcattaggatatctccattttgcaacccttaatgaattaagggataaggcatcaaacagcaacagctgctaacatcacgagagatcaccaaacattacatgactcctgatggaagaacacgccaccacctgtgaagaaatactgccaaaagttggcactacatgccctaaactttcagtgttctcatcagaaaatgacaagtacttggttatgacaaacttcattaaaaatcataataggccaggcgtggtagctcacacctgtaatcccagcactttgggaggctgaggtgggcggatcatgaggtcaggagttcgagaccagcctgaccaacatggtgaaacccatctctactaaaaatacaaaaactagccgagcgtggtggtgtgtgtctgtaatcctagctactcaggaggctgaggcaagagaatcgcttgaacccaggaggcagaggttgcaatgagccaagatcgtgccactgcactccagcctggcaacagagcgagactccatctcaaaaaaaaaatcatgataacaaccatagctgctaacacttactatgccctgggctctctaataaatgctttgtatagatttaatccttttaacaaacctagtgatctggctcctgcctacttttcctactttaatatctgccattttactgctcactcatgactctgtaggcacattagactttttctgttccaggaacaccagactttctcttgactcggcctttacaactactccctttgcctgaaatatctttctcagggctgcctccttttcatccttaggtcccagcttacgtgtcatctgctcagagaagccttctttggccaccctatttaagatggtctccatccatgttgctttctatcatttccctcatatcacttactatactctataactataatgtttatttatttattgtctgtatctccccaatagaaattaactacacagagccacagaccttactgatttcattcactacctacctcatccccagcactagcccaagcttagagaaggtccccatatagctaatgaatgaatgagtgaatcctcacaacaatcctatgagataactactcttttatttatacataaggtgacttcttctactcttcaacttacagacaaggtgatttgagtctgagagaaattaagaaacttgttcaaaaatcacagggctggctagtaagtggtaaatccagaacgtgaactcagggaagctgactcagagccactaggctataatatctttcctgtagataccacatatccatacaatctttatggtaagacaagttattttaaataaaacctttaaaggaatttagcaatagctaaatatcacccaaaatacccattcataggcattacaatttcatgatcctgaaaacaggacagaaccaaaaagtaacattactctggatttgataaatgtgagaaaaacaggaagaggatgtggaaactaaaatatctgacatgaataatcagataacggctaaggtagaaccacaaaaaggaagggggactaggggatttttaaaactggtatttcttaaatgccacacattctcatatcctgaaaactaattgagtcataaaacatgagtctgtttgtaagcagaaatatgacaatgaaatcaaaagataaaatatgataattctgtcacaaatacaaacacaggttttatattatagatctagctatggcaaaaggtagaaaaaaactaagagctatttggactagctagctaaactgaatttaggaagccatgacattgagtgatcttctaaaagagatgccagcatagtaacaaacaagcttttagtttcagtctgtaactctgagctgtggtcctagtatttcttcaacatcatagttgaatatgcaactagctgtggaggaaaggcagggggaagggaatctctaaggctgaaaggcctcttccaaaaaaaattgaagagaactctatgctagagcgagttaaagcataaggtgggaaaaatgtgctctaggaaatgaatcttcttaggaagtatgtgaagtcacaaaaggcttgagtttgaatcatagctctggcatttattagttacatgactattctccactcccattttaaaagagaaatcagtgtttcagcttcttcgtctataataattgggccgacaccacttactttgtgtagagttgtgagcattagtgctaatttaaatacctagcacagtacattgcacatgaatacttgataaacactgattatactcaaatttctcgtttcatgtttctaaatctaatttcacggatctaatgtcataactctaagcagcaatcacacagcgcttccttttttcaccagtgctttacaattattattattattattattatcttggaggcggagttttgctcttgttgcccaggctggagtgtgatggcacgatctcagctcactgcaacctctgcctcccgggttcaagtgattctcctgcctgaggctcccgagtagctgggattacaggcgcccgccactacacctggctaatttttgtatttttagtaaagacagggtttcgtcatattggccaggctggtctcgaactcctgttcgagcggatcaagtgatccgcccacctcggcctcccaaagtgctgtgattacaggcatgagccactgcacccggcctttacaattattttattccagttagcaatggggagagagggttacgtttttccagcatttaataagttttaatggtcccaatctaaaaacaggagcatctttttgagataatgtatatataaaataacttatatttttctccaaaaagaaaaaagtcatacctggcatttggactcagatattatacatggagaattatatgcttttaaatataaactattttgaaagaaaaaaataatagggattttggaattaagacttaactaaaaaactcacctgactttctctttcttttttagccatgagttcaagttcctctttggcattactcagttctttttccagccctgcaactgtgtccaagtctcctaaaatgaaaatatagcactagttttaattgctattaacataatgtggtatctgctgcctcctttgagtaatttacagaggacacattccaataataagaaaaaagaaaacatacacacaagttgttctttatagcattatttataatagcaaaatactgcaatcatcctagatgctataaagaaaagattgaataaactatagtatattcacagatggcactatatactgatgtaaaaaaagaataaggatgatctttatgaatttatatggagtgattttgagattttaagaatatgttaagtaaaaacaagctatgtgcttaagaatacatctaaagtagtaggttttctattaggaaaaaggggaaataagaatgtacatatatacattacatatacgcagatgattcatttgcttatttttgcaaaaagatatacaggaagaataacccagaaatgaaactgattacctgcaggagatgagtggaaacaggagagaaggaacaggaaaatattggacatctgagtatatcattttatatactagagttttgaactgtgtaaatgtttaatttttaatgtgtaagtcagtttgacaatgaatgagagagaaaaggtctaaaattgaatactaatataaataaataaatctatatagcaaatagataacaaaaccatccagaagataataaaaaaattaatccaaataatttttgaactcactactactctaactgaacactgtcagtgcaaaatatcctaaggataaaaagaattacaaaaaaatcttaaacattacttaatacatttattgttgatggtgatatttatgtaacaattccaaaaatacttttgcatattatagtattctgcaactgtgtaaatattttgaaatatattgatgctataagtaaccagggctctcaaggagatacaaatatgaaatgagggaaaaaagaacctatattgttaaattggaattaaggaaatcagtatcaaatcttcacatatatacaaatacacacatacatacttaaaaatattcattgctagttctgttctcttaaaagggcctagaagcggctgggcgcagtggctcacatctgtaatctcagtactttgggaggccgaggagggcggatcacgaggtcaggagattgagaccatcctggctaacacggtgaaaccccgtctctactaaaaatacaaaaaaattagctgggtgtggtggctggcgcctgtagtcccagctactcgagaggtgagcagagagatcgtgccactgcactcccacctgggtgacagagcgagactccgtctcaaaaaaaaaaaaggtcctagaagcaaaaggcattcatgtagcaatgaacacatcttgtgtccagatcatagtttctgaatgccattacccaccaaaaggaaccagggagctctttaggataatggctgattctgggactgaggcaggtaaagcaaaaggtaatcatagaacatcttattgtgccagaaactatcaaactatgctaacattatatatatatataacattagtaggtgatgtcaagttacagtgagtggccccagacttgaaacgatacccaggaaaaggtgtcagctcatggccctgctgtgcaggattggaacaattacctcctgcatttctgaatccctgcaaagctatctgaaaaggagagtaaggatagaatttctctgggccgaattgtgaacccagagcaatcagctcaactcaacataaggtaaggacagttcttcagcctttcagaggaattccaaacttatttgttctattaaggtaggaagagaaaagagtcttggccaaacctataatacagagattactagaagaaaaaacaagagaaaaacaaagtcccttaatgaaatgaaatttgatacttacctaatgtggatctgggtatgctgacatcctctttggcagtcaatgaagtgctatcatctctggaaggtatctgcattgaaccctaaaaaattgcaaaagtcaggggacttaggaagatgcaggaactatgatcacaatgacagtactgagaatattctcagaatttggtattaaaattatcaaacttacacctcaaatgtaaaaaggaaatggaatcagcatgaattatgtaagtctatagttcttacttgatcagtctgttttccaagacagccagtgggggtaacttcagcttgttggttagagatgggtgcttgggacatcagggagtctctccctcctaaatattggcgcagggcctgtaattctgaatttctttccattaaggcttgcaccaacttctctgcagcagcctagtaagaggaaatcacaaataacattataaagatattctagtaaaacaaattttttgttctggtattatttcttcaaagtcaaccatttgtaaaaaacaaacaacaatgacaacaacaaaaaacagtgggtccttaggaaatagtttccttgctttcagtttacagggaaaaacagagttaagtgaatggaaagaaagtctcataggcagaatattgggaaaaaaaaactgaatttaacacatctgtaacagataagagaatctgaaataggttctgctacaactatcaggctaaggtgttaagattctggtttgaattagtataacaaatgtctttattctcggatagttgcttcttaggggtggattccttttcactcaaacatttgtgtggtttgctcccttcaggtctttgccaaatgtcaccttatcaggttggtctttcctgcgtatcctatccaaaacagcaatcttgctggccaaagtataagatgaatatgttttggggatccaatgatagcatggtgactttagttaataatactgtattatttacttgaaatttgctaagagagtagatcttaagtggtttcaccatacacgcataaaatgtgtagtgacggatgtgttaatttgtggcaatcacttcaaaatgtatatgtatatcaacacatcatgctgtacaccttgagtatatacaatatttgtcaattatactttaataaagctgggaaaaaaatttttttaaaacccagcaatctcttctctatctccaacacttcttactgtgcttaattttttttcgatgcacttaccattatctaatagatctctctctctgcttcccctacatggaatgtaagtttcctaaaggcaatttggtgctgaatctcaagcacccagtacggtgtctggcacataataggcacacactacatatttactgaatgaatcaattacgcacataaacatgtttatcagaccacatgattaggataatctcaacctcaaaatcacccaactcagcttgtttcatttcaaatcccagttttctaagacagatgatgacacactaagggaaagatctagaacatttttaactattaatgcacaggaagtctgcatttaaacagaaaatctggaaataataaattgatattaaaattactgagggtctaagatgatgaatcataacaccaactgtctctgaggaaaagtactattgttttagggcagaagctgagctcttgtcacaatttctaggggaaatatgaaaaaaccttccacttttcagtaagtaaaatttgggctctttggagatttgaatttaactattttagacgtatcagaatattattaaagtaccttaataaaaatatctgtgaaaactgtggggaaaaaacataataaataatatacaagatatatactgtgctctatctgccttggcactccttttctcgtagtatttaagagtttttagcagtgctcctccaatgcagtccccgaacctgcagcatcactatcacctggaaacttgttagaaatgcaaattcttaagtcccacctatacctcgtaatttctttctctggagttgagctccacaatctacatctttaaaaagctattcaggtgatttcttttgcacgtaaatttagagaagcagatctagaagaatacaaccattaatcttcttgagttgaaaaatctcctgtaatttccatcatctccattattctattaccagcagtgcataattttttttctgaggtataataaagaccaattgtcccaaatcacaaagaagttaaaaagaaaactcaaagatcctagcctcttgccaaagatttaaataatttagaataattttgttaggtctattttagaaacaatttctgaagcacacagcaggacctttctagaaagatgtgtatttacttcagtgggcctaacaattagaatagtggagtataatcctttcacaacataagaaaacataagaaaatattatggggtcaaataacataggcaaaaaagagtctatcttcctctaaaaactgactacggggattctgagctactggtatctgaaatgcagcacaagtcaactaagagtttttagccttgaggagaaaacacatagaaatgaggaaaaattaacactttactatgggcagggcatggtggctcacgcctgtaatcccagcactttgggaggctgagatgggtggatcacttgaggccaggaatcgtaagccagcctggccaacatggtgaaaccccatctctactaaaaatacaaaacttagcgggcatggtggtgcatgcctgtaatcccagctacttgggaggctgaagcagaagaattgcttgaacccaggaggcagaggttgcagtgagccaagattgcgccatcgcactccagctgggtgacagagggagatgccatctcaaaaaaaaaaaaaaaaaagaatttacttcttaaatattgtgaaattaatataccctgtactattatgagattgtttattctcaccatgacctctgaaaaatgcgatcttttttccctcttaactcagattttacaaaaactaagagtaaacatgttgagtgtaagttttcccataccttgactggaaatgcaaaatatcactcaagtcttaacaatttagaatcaaaatcgaaacactcacaacccctactcctttctctcaaaattatcagattattaaggaaaagaaaatgtatgtaatgaagttaatggatacatgtattgtttaggcacccttccaaatgcaaggttttcaagaaatgtgtcatactttgatgattaatgtaaaactgtggtctaaggccaggcgcagcagctcacacgtatagtcccagcactttgggaagccaaggcaggatgattgcttgagcccaggagtttgagaccagcctgtgcaacacagcgaaacccccatctctaaataagtaagtaaataaataaaactgtggtttaggtaataaatagaaggaaagaaactaacagagttgacggtaaaatatataaatatacacacatctatagtctgcaaatgcttcctatttgcagactataaatgcactacatgacacttgtctgatctgtgcattaatccttacttggctttcctgctccctggtgctcacagactgaagcaggccttgaatctccatttcatgttccagcacttgtttatttcgatcacttagaaggtcctgcagcatcctttcctttcgctgtagacgctggcacagctcctctgctatctcactctgccctggtccaagtttgcagagcagtgttgcactaagatcctaatgcagaaaggacactgtaagcttctggaggaaagaaatgcctctgctaaatatcaaagggcttataagaatctatcatagaagaaggaggtgtgagattcttgagaataagtatcatgttttactcatttttgttttaccagatctagcacaggcctgctacacagaagtctctaaatacatgtcccaggaatgaatacaaaccatacagaaaactatctctggtggccacttacatacatattgttttctgaaataagtctttttcctatttgttcagggcatgtaacaattaatgttagatgaggataaatggacactcagttcatttatttgttttctccccagtgtaacttaacagggggaagcataaaacgataagctgaaaggaatactaaacactatatttgctatcatagcgatggtttctatttctgtactaactgatggcacatggtggaggaatggagccatactgcctaggttgatactggatctgctacttattagctatgttagcttggacaagttacttagcttcagaagtctgtttcctcctctataaaaaggaataatagaaagtacctcatggacttgtgaggatccaatgagttaatatccattaggatcttaaaacagtacctgacccagcatgaagactataactaataaaggttagctatcatgttaaagatgcaatttttgggtctcattaattctcacataagttctttgagaaagttaattgccaacttaagtttctagacgtggggaaaaaaaaaatcccagtgaaagtcaatgacttgcccaggcacagaatgaaattaaagacttgggtcacagtcctcccaatctgaagagtcctaatccaaggctgagattacataatcactgaaccaactgccttaaagttaactgaagtcttgcctccacttctttgttcctatcatgaagagacgtctgtaactgctgaatgatactctcttgttccttctgccaacggctaaatttggtttccatttcttctttcagccactggaggttttgacaggtagtagataactgttccacttccaggcctttggccctcaggagactctccatactctacagccataaagagagcaataatcagtcaaaatgattaccccatactcctcaggataaacaagaaattagatccacttttaaataatctcccatcaatttttttttatttgcaagatgagaacattgatctaacaatgccatactaatctatttttttggtttttagaaacttttatctagtttgtggagagattaaatatagaatatatgataaaaggaagtattttggaggaagtgcactaagctataaaggatttctcgaaaaagtggcagatagatacataagctctaaaataaatatgcaaaaaagtccacagtaaatatagataaacaagtgttctaattatggcaattcatggacatgtagataatattaatgtagaagacacaatttaataattgcaccctggtaatgcttcagtaaaagtaagagagagagagaagagcgtgtgtgtatgtatacttatgtatgaacaagaattggaaataaatcagaactatgtaaacagaaatcaatatttactggctctcctcacaaagttcatattacaaaagaaaagtagaagcgctaaaatctctcacttgctaattgacaatgatggaactagtaactgctctttttggttttcttcccccttataaagcaaaatccctggttttcagaaaatgatggaagggggtcatgcttcaggctcaggatacaagtgggagaggaacaccaagtcagagataggttttgctcttacttgcatagtagcttcattggaggagaggacatcgcgcagtctctctaagtcatgatctcgctctctcacagcaagacgaagctggcgcagttctttttctttctcttctagagcagagaatttttcatctatagcccgctgcaaggaaaggaagactcctaaagctctgtaagatttactatcctgatcactcttattcaacaagatggcagaatagaaaaccaaatcccaaagcagcaaatttaagcaaacacaaatttctataatacctatgtagatagaataatccatagcatagtgggcgaaatgatgatacatacctccagagcaacagctttatcatgtattcgctggcgaagtttctcaagcaacatttcatttgcttcaagggttttgtctgagttatctcgatactgtaggagctcccgaaattcctgagaccaaaaatagtttcttttattcttttatccaatattaactaaattaccaagtaatttgctagttattcaggataaaaaaaaaacaagatgtgatcactctcctcaaaagtaacaagtttagcagagataacagacatataaactgtaaactattctgcaacatacaacagacacaacacatagaattaactgttctgcaacatacgctagccaccaggggaacacaggatgcactgcctaactctgcctgaaggtgtcagtaaagacctcacagaggaggtaatatttgcagtgagtcttaattaaaggactaggatttcctaagtgaagaagggagaggaggatacgttagagaaaaaaaaatatgcacactatgcatacaatgaaaaaattgtacattcagtgaaatgtagtggattcaatgtgactgaagcttagagtaggtggcagaacagatcagtctcttcttaatgctccatcttcccctcaaacttttattctatcatcaaaattactctgtggaagtttctgtacagtttgtcttcatctattaaactgagatcagtagccaaatcttttgtcttcccaacacccagaaaagtgtttgattcacagaggtgcttaataactattttctgaatattaagtctttataaaagacttcataaaagactgcttaagtcagggctatatgtactgtttcttatacttgttagtaagcatcttaattcacaaattatattttctatttattttaaatcctcctgattcccacctctctcaatgttttccatatggcagggactcagcacaggtggattaatatcttaaaattatataaacaaatttcagagttctatgagcccagttttcattgaaatcatgtaaactcacctgaagcaactgctccttgtgactcagactatggtttaggtgctggatgttttgttcctgggttcgaatctcattgtatttttcagcctcccaggcacgaagctgttggctcttattctgcaattcttcttgtagctgctgcaaggcttttcgcaattcctgaattaaacatattacctttttaaagagatctaaaattgtcacatggttattagatacagaggccttaaaattttcaaggtatataaactgaaagaggagcagagggtgccattattaaaattgctatagaagtattatacatgaattgaataggatatggaaaattgtaaaagttgtgaatggggtaggaagtaagcttgatattatagttcaatacttattttttggcttaaaaagaatacatctatagaaccattaagtgagaatctgtcctacggtaaacctggattatttacaataagctcaaggataaactattcctatcatccttttttctaaagatctcatagagaccatcactcttctttcttagtttgccatatttatttttctaataataaagtcagtaatctttaaatcatctgttactttagaaagctaccaaatacatattctcaactaaacaaatcttggggaaatgtttcctttagctaaataacaaaaagttaagaattatttctacctccatccctccaccactccccgaccctgcccagacatctgaaattttaatatttcttttttttgagatggagtctcactctgttgcccatgctgaagtgcagtggtacaatctcggctcactgcaacctccgccttccgggttcaagcatttctgtgcctcagcctcccaagtagctgggattaaaggctcctgccaccacgctgggctaatttttgtatttttagtagagacggggtttcaccatcttggccaggctggtcttgaactactgaccacatgatccacccacctcggcctcccaaagtgctgggattacaggcgtgagccactgtgcccagccaaaattttaatatttcaaaaggaaattcagggctaatatttgatctccaaaccactaaaccagggagatccttcaaaaattacttttaaacctgagtgttaaagagcttaagaagagaccacacacaaaaaaatcttttaaatcttaaacaaacacatacactctgacctaacaagataaaggaaccatttaagagttgtgtattttggcccagcgtggtggctcacgcctgtaatctcaccactttggaaggccaaggtgggcagatcaccagaggtcgggagtttgagaccaacctgaccaacatggagaaaccctgtctctactaaaaatacaaaattagccaggcgtggtggcgcatgcctgtaatcccagctaccaggaggctgaagcaggagaatcgcttgaacccgggaggtggaggttgcagtgagccgagattgtgtcgttgcactccagcctgggcaacaagagcaaaactctgtctcaaaaaaaaaaaaaatgaaagaaagaaagaaaagaaaagaaagagagagagagaaagaaggaaagaaagaggccgggcgcagtggctcacgcctgtaatctcagcactttgggaggctgaggcgggcggatcacgaggtcaggacatcgagaccatcctggctaacacgatgaaaccctgtctctactaaaaatgcaaaaaaaattagccgggcatggtggcggccagtgcctgtagtcccagctacttgggaggctgaggcaggagaatggcgtgaacccgagaggcggagcttgcagcgagccgagatcgcgccactgcactccagcctgggcgacagagcgagactctgtctcaaaaaaaaaaaaaaaaaaaaaaagaaggaaagaaagagagaggaaagaaagaaaagaaaagaaaagaaaagaatcgtatatttattattcaaaaataaaaaataaaaaacagggctgattattatgcatgtcattcctctgaccttagtggttcttccccacttttctgcctggttttacccatccttcaagaataacctcagatgtctcctccttcatgaagttttccttgattccttttccttgactcctttcctagatattcctgtaggaccccatatatacatccccttcagaatttaccacactgaaactcagcttatgtgactgtctctcttactgaactataagtaacttaaaagaaaggagcctgtgctattcatccttgtatttccagggtacaactcaatacggcagtcgccccttacccacaggggatacattctaagacgcccagtggatgcctgaaaccagatagcactgaagcctgtgtatactgttttttcctgtgcatagataactatgataaaggtttacatacaaattacacatactgacagattaacaataacaataaaatagaagaattataacaacatgctgtaacaaaagttacgtgagggaggccaaggtgggcagatcacgaggtcaggagatcgagaccatcctaacacgatgaaaacctgtctctaccaaaaatacaaaaacaacattagccaggcatggtggcgggcgcctgtagtcccagctactctggaggctgaagtgggagaatggcatgaatacaggaggcggaggttgcagtgagcggagatcgcgccactgcactccaaccttggcgacagagcgagactctgtctcaaaaaagaaaagttacgtgaatgtggtctctcttaaaatatcttaatgttttttgtctgtggttgaccccagataactgaaaccatggaaagtgaaactgtggataaagagggactactgtaactagcatatggtacaagggcagcaagtgttgaactgaaatacttagattatgcaactgactcaagggttcaacacaaactgtcctgctaaaaagttatgatcagggcaaagtcagcatttagggcaataaaatagttaatgatttacctggttatgtttccaagaagcctctttctgctgttcactctcgtgtgctgcagcctctacaaattgcacacattgtttggcatcagccagttggcgctctttctgtcgtaccaccctctggagcttctgtatttcaagttggctgcagaataaagcactctgaagatcaagcagagctacctgttgctgagctggagaagtaccctctgagctctgaaaagagagtagaaatcacaatcacaaggagggcaagcactgagctcccacaaagactaaaaataaaatcaagactgcaaccaaaatggcacatccccaactgaagtctctcctgtcctacgtgaccctcacatacgtgaagttgtccaagctggctttggtgcagcatttctcgaagctttgccattgtgtcattttgaccttcaattacctggtacaactcctcagtctgaaaatgagagagggaatatcaaatatgttagtaaactaattataaattccattatatcacctgtacacattttagtaacaggactattccaaaatatcaattgagattaagctacaacttctccaggctaagacatgctagtctgacaatatccattttgacaaaatataaaatacttgtctactttgaagggaccaattgtttccacacaggtccttgattggtaaatatgttacctcacgttccctgcttttcagagtttccttgaggttctgaattgtaccatcttgcttttgagacgactcctgagcacactttagttcatagctcatttcattaagtttctcttgaagaatctgaattcagcaaagaaaaacagttttttaggtcaatgatgtcttttagcctcaaatgaataaagcctttcctcaaatctaggatttaaagaatttcttaggggatattaccttgttatttttcctacatagagtaaccattaaagtggtaagtcaatcagcaacaaaaagtagcaggagaaatgaaatacttccttcaatactaaattgtctcaattttcacgcactgtgatctctctatgatggcagccatactaggaacttgtccacatggaccaagtaggcaagtggtttctaatatggatcccttatacaaggaccaaagagcttctgctatctagcataggagagggcactataagggcacccaggccacaagttcagcatcccaaattgtagcaattttcttctaagccagacattaaaattcatgggctagaaagtagtaacaagttaagctaaaataaaaaacacagacctcctatctcagtgccttttacagtggaagactgcatgcaagtgtttttttgagacagagtctctctctgttgcccaggcctgagtgcagtggcatggtcctggctcactgcaacatccacctcctgcgttcaagcgattgtcttgcctcagcctcccgagtaggtgggattacaggtgtctgccacaacgcctggctaatttttttttattttttagtagagacagggtttcaccatgttggccaggctggtctcgaactcctgacctcgtgatccgcctgccttggcctcccaaagcactggcattacaggcatgagccactgcgccggcctgcatgcaagttttaattacacacctgaaaagcaccagaaattatgatctgtacagaacaagctaaaatcttcataagaataaagagaagaactacacttttacatgaaatattccctagagcacaaggagtacacagtattcatctcccaagtcctacaaaggttgacagactcaggctagagccagtcacatcctcaggaaaaccttgtcatctcctagggcatagtactaatcataccttgttggtggcctctgtttgctggattttttcctggagttctgccaagtgggaatcagatacagactgctgagttatagtggtctcatgtgaattcagcttttgttgtttcagcaactcttcagtcatgggctaggaagaaacggcaaggaagaaacggcaaaacgagtaaggtgagttaaacatggccaacaaaattttttttttgtcttcaaaaatgtctgttgcatcttttgccagagatttagagaatcagatttgttgcataaattatcagtatgaattcctaaagacaggtctgttccttattaagaacactgattcacctccatttgtactatgctccccagcttccctctccacttttctgtaccaattcacacaaacactacatgtttattcagcgaaagcaagtaattcagagttcaatgagaaggggaggatttaataaaggaaatgcttacaatgaccaaatatttgctttattctatttttaatcaaggagttgaaaaggcatactcatcaaacttacacttcctgagagaagttacattccggctacctttcttacaacatgcttgtttcacattattggaaaaaattggcagattttgatatggactatatattaggtaacagtattttatcaatgtctaattttctaaatttgataattgtactgtaattatataagagatgtccttgtccttaagaaataatgcttaagtatttagggtaaaggagtatactatctacaactaattctcaaatggttcaagaatttttaaaaaatactgtgcaaatacagacagtgggagagtttataaagcaaatgtgacaaaatatttgcaactggtaaatctgggtaaagggtatatgggagttcttggtatttctcttataacatctctgtacgtttgaaattatttcaaaataaaaagagaaaaattaaaataaatttaaaatagatgtgcctaaaggcagatttatagcataagcacagataaataatccatagtgaaatgggaaagagatatattttataggaatatcaattcacttaaaagattcaggagaaaaaagtatgattttatatatgggacaatttatatatggaacaatgatttatatatgggacaataagataaacttattgaactattcttagtaatcattacaagctaaggatgttaaaataaaactacaaatttactgcggcaattaaatttgatcttcccgcctccatacctgcttccattccaattaggaatataaactcattaagagagaaaaggcaactgctattcattttttgtttccctcacactttcagacttgattaccactttcaaggcagtggagttacagcttaccttaaatcccttcctgccagcaactgactggaagcataaaaattgcagaagaaaaatctcttctattcctccagtgctatttatcaacttttctaacacctactaaatgctataataagcaaagcaccatgtgaggcactgtgaggaatacaatgctgacataacatatatctgttgcacactaactatgtgctaggcactgtcttgaagatagagtatcatgcaagacaaagtccctgtgctcttgaaacttatattttgcaggggttggagtggggagtacatgataaacaaacaaggaaatgcaaaaaatattatggacaagccctgtgcggcaaaacaggaaagcataatacagagtgggtggttaaattaccctaaattgtttgatcagagaaaggtctttatgaggcagcatttaaatagatatctgaaggaaaaagaatcagtcctgcaaagatcagcagaacaatccaggcagaaagaacagctaatggaatatgagcctggaaaagagaaaggcctctgtggctagaatagcactctccagtagaaatataatgtgagccatgtatgtaatttttaattttctagtagcttcaatgaacaaagtacaaaataaataggtaaacttaattttaacaaaatattttatttaacccaatatatccaaaatgttatcataaacatgtaaataatataaaaattattaatgagataacattattatctgagataatattacatgatttttcataagtctgaaattcaaggtatattttatactcacagcacatctcaatttggactagccacatttcaagggttcaacagctcctaagactagtggctagcttactggatagcacagggctagagcatagtgggcaaaggggacagggaaactcaatgaggtggagaggcaggcaggcaccaggtcacatccagcttcagacaacaaagttaatgaactggatttcattttaattgaaatgagaatagactgcagttttttaacaggtaatcatacagaagttttgaaaagatcatgctgtggtgaatgaattattggggagcaccaagagaagcagagagaccaggtaggaggctgctgcggtagtgcaggtgaaagacaatagtagcttggatcctggtggttagtaaagggagggggaaataaatggatagatatggatatgttttgaaagtatagctaacaggacttgctggtggactggatagagggagagggaaaaaagcagcaaggataatgacttctggaaaaattatttgagatatttgttgttgtgggtataacaggaagccttcacctgaggcaatatgaactatgtcacaccatgggcaaagtaaccacattaatagatgtttacaatgattctaactaataaataaattcatcatttacttaatgataaaaccatctctataaaatttggcttcttacttcttcagcgtaaaacaacagtaacacctacagtaagatactttgaaattcaaactacaacaggcagaattaaagaaaatagcttcaagtttaaaatggcaaggaaggtggtcatatttatttactttaaaccaaacaatcttacagtggtgaaggaaactttataaactaaccatctgatccaatcctattttacatacaaggaaatggaaacttagagaagtaattagtccaaggtttcatgggaaatcaggaaaaagatccaattaaactgaactggatttccactcaggttgggaatgtatctctcatttctataaacccattgcctaccataatgccgggaatactgcagagatcaaaagtttttgtttaatgaacaaataagaacaataaaaacaaacaaaaacgagcctttagtggctctcttagaaataagactgtatataacatatattcgaacagcaactttaaagccaaagaatgccacaggaaaatacataatgtatttgaatctcatatgaatcaatcttgacatgaataataataagaaacctctttttctataaataatgtactgacctaaaagttggaagatatttgtttcttctttatttgtaataatttactattttgcatctcagaaaaatgtccttgcaggtaacagtctgctgaaagagcacttagcaagtcccactaagccaacaacataatgaattcttgtgaagtatcaagtacataaaacagtcactcctacaatgatagtgtagcccatgaaataagtaatacctgatttggtagaatcagtgttactctctagacactcaggtactaaaatcatgtggaaatgataatataattttaaattaagtcacttttgactcagaattaggacaaaggctttccagtatcagaaaagagaaccgcttccaggcctagtgttgcacaatatgagacttttttttaggctaaggccagtttttagactttttgtgttaacagcagttttcttggcactttctagtcctcacagtagtgagttatagatctcaaactgctataattgtcaaccctattgttaataataggagacagacaagaaccattgactaccataaaattaaaggcctaatcttttaccagcatctaatgccaacatcttccaaagggcctgatccacttcacataactaaaataagagtgggataaatttaccatagtcacaaaggagcagaccttggcattgcaaggtttaaggcaaagatcttctgttctttgaatttagatagaaagggaaattgcacatgggccagagctcattgctgtttactaagggaccacatccctcccatcatagcttttctagttcagggccagacaataaagaagggaattaccagctagaagaaggcttcaaacctttctttagatatctgaacagccttaggtcctcatacataaattctgtagaagggaaataaattactttgtataatatcagaatatcagtaagcagaactacactgttgctatttttctttaataaataagaaaggaacaaagaaaaagacggaaagaaggaaagaaaaaaaagaggaaaagcaatcaggaggaatcctgatgtcaatatttaatagtgcataaaatatggtaagtggaggattaaacaaaggaatcaaaataaccttacagaacaatcttgctctttaagataaaaggttttctccatatttgtggcagaactgaactaaaggaaacatttttttctttcatggtttcgtgtttctacaaactaaaaaagagaactaccaaaaaaaattatattatttctattctttccatatttgttcagagaaatagacaaaaaccagtctgccattgtcccatctagcactggttttgtcataaggctcttaaggagcttaaaagtaaccagatttaaacaatagatacaccgcccattttatttacaaacatgttgggcccaattcatctattttccctgacatcctaaattattagagaaaatggcataataattaaatgccacatttcttgaagctgaatgacattttctcccacctcctaatttttgtttttctagaaacagtaaacaatgtaagtcaagtcacagcagaaaggtcatacactaccatcttaaagctctaatgtccaaatttagtgaagtaaagggacttgacctgaagatacagttaccatagtttatatgtgttcattcagatgacaatttttttcacataatctctaaagaatcctccgagcatccttaggttagagaaagagggctcctggtttaaaataagtacttacttaaattaatatacttcagacaatggggtttaatgtatagaattaaagtgtcttgcctgagaatggtcagaaatctttgtctctgcatgggctacgttagttaaacaaggaactttccatatctccaaattgagagactgcctgaagatgatctttaaaatccttctccactccaaaatccagtcaccaaaatatagtattttatttaaatacggagaaaaaaagatcttgttttggctgttattttctcagtctttatgtaacgttctacaatattggtcatatttggtggcgggctggggggacgagtttatttcccatccatcctggcccaactaattttagaccctaatatgaaaacaccatgtttaatttgtaacacctatgtctagtcacagaaatactgtaaagcccaaatttagctgcgaggctccactgaaagaaaaagcaaaagaaaagaagtacacagtgttaagcatacagtgcttaacattttatacaaaatgaaaatgcactgactttttacctttcatgacactttcatctatgctgtttctcatctatgctgcttctcataattttgtgtaaatttaaaaacttttctcctgttttctgcttaggttcttattgtgatagacagtatacataccatagaactactttccaaaaatttcaagtggccatcaacaatgtcacttatcaagctctaaatttctggaatgacgttgaccagtagcaggctttctaaaaaatgccttctagatcacatctacctttgtgacagtattgttaaataagttgtatcaagtggaacatgccagaatgtttcacaaagtttattgaagctagcatttactgttgctatagaaacaaactaccatagttgaatttaaaaggttggtacagaatcaattgggcagacacgaatagctcaaattaagcaattaagaattcaagactataatgaatgaaactctcctctgatccaataatgggttaatcctttcttaatatcaaatatcttccagtagaactcagtagagttctggctgtgaacagtttatgccttaatcttttgactgacaatactgtacttgaatacttgaattcctgtctcttttatgaatgagtcatcactaatcctcaaatgaactattaattctaattaatatggtccagatgttataatactttactggtggattaataggctttccccaaaccttttaccttatgctctaatcatttacaggcattttgcggatgaaggctttaatgctccaggaagaactaactagagaactaactgccttacagaaaaccattgggaggaaacgtctataaatctgaaaacaagaacaaattttaaaagttggaaaaaaaaaagaggtaagaggaaaagttctagtgccagaaatgagattaaatgtcttctttttataggaaaaaagtgaagtaggaatctttacctttttgttttaaaaggtatacaattttgataatgggaaagtcaacagattttacaaaaaggattgtgaaaatcaaattatctgagtgcaaatcacgtttactaaatgagacagagcaaaaggtgcagcaaaaatggggtcatgactaattttctcaagtccagaatatttctaacctccacctagaccgaaatcacgtgaagccagaggccagctagctataatcagaaaggcactatgtagccgttttgtatacctggacccggagcggcaaataatcttcacagagatcatcccacagctcctgcaggtctgaaagctccaagggataactcacaggtgtcttgtaaaggggtttcaaagacctgttaaggaaaccggaactaactccatctgtcatgctagggccaggcttggctccaggtaggctggatttcactggaatcggaagcctgctccctcgggggctctggatgggcttataatcaagacctttaatcatgctaagagctaattccagcttgtgattacacccatgctgcggagcctgatcatctgaacaacagtcacactttccaagttcctttgcacttctctcagtctcctcatctttctgttgtggagggctagcctggacgcttgcatccaaagattccacagaggaaccaggcgtctcttcctccatgctttctccatctgggggtacctttgtgcttgctaagtcgggtggcccaacctcagacaacgctggttcttcagtgcaaatgctggtcgaccacctgctagaagggccgcaggagatacttctggccacctttcgaggtaccttacaaatggcttcatagtcagaatcagcaacccgcaaagcggcacaaccacggcatctcctgggtcggtttccagggccttctgaaccatggcagctgtgtggctcctggatctgatcctcattctccacccagcactcaaaccctgaataggcgaagtcctcctggagcagtgcagagtatctcgcatcgggtaagacggacatgtcaaccgtcccattccccgccttgatctccgcgccagagtcatcgttattcttccgatacatactggcaatgcagaacttgaggcgatccttctccagtagcagcttttgcaagcgctcaatagaaagcgcttcaatccgggcaataactgtgtcgaatcgatagattcgatcaagcatgaaagcacacttgctgcaagcgaactcggctttgccatcgcgggggacatccttgcccaagacgtgcgaaagcagaacctggagattgagcttggacgccgtgtggaagatccagcgccgctggtttccacacagctctcgggcacagatcctgcaaatctccttcatcttccctcctagcgggtggcaagcttcccgaggcggcggcggcggcggctactgggtgaccactcaatggctcttcgccgcgctctgtctcccgcctcggtggtctccggtcagcatggcacagcccagtggggtccccactctgcaggggcgcgcccctgccccgcgcgccgactccgggtaccagagccgtcagccccgcccctcgggcagggggcgggcgtggaaacgcctaagaggatgctgagtgacagaggcgcaggccgcgctccgaccctgccatgtctctccccagctgtctctcccgccagccgccgcgtcctcaacgtcctccccttttagcagactgggctcccggagcagcagcggccggccgcgcagacgcaaagcctcggggatggaggatcagatttcaagatggcgccagcggcttcgcgtctgcggcctccacaaggctcttctgggagctgtagtccggtcagcgggcttccggctctgcgcatgcgaggtagccagcgcgaccctcgccccaaatccggttgcacacctggctcacggcgagtgcggagcagaaagcactactggcgcgggccacagccagccgctttcatctgctaagacctcacctgaaagtcgcaccagtgccctcaaggatcctcccgcctctgcaggatgtcgaggctcctcctcgcggggaggagaaagacgaatcccctccctgcattctcggacagtgccacgtcctccggctgccagcggggcagcgccgctaggtaccgctgcgcgccgcccccgcttcccgccagcagcctcacctttcccggccccgccccgcctgggttctaagggcctgaggctgcgaggcaggcgagggaaggcttggtaacggaggggcggggccgtgcaacccttacctcgactctgaacaggaatgtccagaaaagagtagaggagtgtttctcccttgatgtgggtgggggagggttagtacccgtgggtgacttgcccttctttagataaaaaagcacagagcagtcacctgagaaagagtccggcacatacaatgtgaatctggttaaccaagatcttgaagatagtagaagagaaatgggcttttttaaggatgcagccagccgcgagtagattaccaccattgaagtccctttccctcaggtagagggcagtcattattttaggacaggggacggtagacaaacactagcgcaaaagacagtgcttctttccgtaagagctggagtgtctgggaatgcagctcgcgccagaaaggactgggaacttcactgacttcggtgaaaaccatgtcttactcagcattgtacagtgataggtcctccacccttgggtccaaaacttagattgcacacaaagaggagggaagctggagccctgactaggtagaatgctggtacctccggccatttttaataaggaattatcttcctggcttgagaggcattcagacacgtaacaagaggaacaacctcagcaatcacttgcagtcccctagagcaggacatttcccagttctaatcatgctaaatttttactaacttgaccttgtaagctaaggccagcaacatctaagtttttctgaacctcatccccaggacagagtccatactcctaagcctgaagacatccaaatgccatctctgagagttcataataagcccccaaacttcttattgaagactaaatgagatgattttgaggaaatgctttaaccgtgtttcgctcattaaataatagctaatattattattttactatgaattggaatattttcagtaactttaaaacattatggggccctgcctacataagattgtattgttctcttaatcaccaaagcaaaatcttgtagctccattgtaagagaaaaggacagttcttagagctttgggcttagtaggtgatatgatttgaatatatggccccaccaaatctcatgttgaattgtaatccccagtgttggaggtggggcctggtgggaggtgtttggggcggtggggggggcagatccctcatgggtttgtgctacctttgcaatagagagtgagtttttctgagatctggtcatttaaaagtgtgtggtgcctccaccgctccatcttgctcctgctctggccatgtgacttgtttgctcccccttcaccttcctgaagcctccccagaagccaagcagataccagcaccatgcttcctataaagcctgcagaactgtgagccaattaaacctcttttctttatacattacctggtctcaagtatgtatagcaatgcaagaatggcctaatatcataggctatagaattttgcatatgtaatttcatctactatgtatattctgactcaaaaaccaagaatagaaaagcagttcaagtaaaaccacagctgcatttttgcctgcctctaggtatgtgagcttcaaagttggaagaaattaagcaacatgctttggaatctatggtgatctatagaaaggcaaagtttctggactcaccctgactgatggaaagacagactgcctgccaggacactaccctgctgtacccagtcttaagtataataaagatctcattttttactgtcaatgcaagccacattttcctattaggaaaatgtgaatgaaacaaagtgctcttcaagagcaaaccctgaattatattttgggttattctctgttcctcaaaaggattttgcatctaactgatagtctccaaattgtaatgacagtatatagatagcttggtgtagacatacaggtcaatacaaatggagaaaaggcaatttgccattgaagaatatgtttgctttaagtaaagatcaatatactaagaaagctatacatatctagacttccaaaaacagatgggaataaactactcagcaatcagaatattcgaagatggcactctgttcacttccagagaaaatagttcaaaactgtatctcaaagtggatataagctattgtactagaattagtccctgtgtgagcatttggcattataaaataagatgttcccaattaaaagatcactggtatgtagataataaaacgtgaaaataaaaatttaaaaataaaacaaaaattatgtgataatcaattttgcactccttggtccttaccattattatcttgtggtcaagagtttgcagttgaactggttacctatggtggggctacacaaggacatttactttttattctacatactgtgtatcatttgaattttggacaatgaatgtttattcaggtattaattttagattttatttaatttagaaaacattttatagttaaaataagggctgccaatttaacacactaatgtcagggtctaagtggtaaaacttgaacctaaaataagaatttttatactacctatgataaatatataatataagaagataacttatataaacaaaagttcaaaggggatccacaagttattagtaatggttatgtctagagagtggaattatggacatttattttcttttttccttattttctataattttttacattatgtattacatactttaaataactttaagtacttactgcttttgtacttaaatatataaaaagaaaaaaatataattgttactaagaaaaaggtagatgaaacacattttggtgtattcatacaatacaatacagtactagccagcgatcaaaaagaatgaactcagatacatgcaacgtggatacatcttgaaaacattttaagtgaaacaagccatatgcaaatgagtacatcctgtgtgattccatttatttgaagtctgacaacaggtctacagccgtactaccctgaatgcacctgatattgtctgaagtctaataacagactataggaaaaacagatctattgtgatataagtcaggaagtggttgaacggtgagagacagggtgagaagtgattgcaaaggggcacaaagaaattttctgaggtgatgaagctgttctgtatcttgttttggatgaagataacataggtgtatagaattgttgaagctcattgaactgggcacttagatctgtagattgtatacatagtatatttcaattaaaaagattaaaaggagtaaataaaactatgtgtttccctcaaaattttaatttgagggatttctttggtagaaagtcacccgcactttaagaacagttttgaaaattagggaaatgctataaaatatagcccagaagaaattctgtaaaagacccaattgcaaattaaaaacttaagcctatccatatgagtttttttttttttttgagacggagactcactgtgtcacccaggctggagtgcagtggcacaatctcggctcactgcaacctctgcctcccgggttccactgcgccccaccttaggataatattttatatgcatatgtacaccaaacacttatgattggaggaaggcatgttgttaaggtgagacttagggcttttgtaatgatgtagtataaaattattacttctaaaacgtagtgaaggcacataacgaaaagtttgagaataagcttcatattatgattaaacaaattattaattttatatatcaacagttcaccctgaacattgattaataaatacatttacaagcatttacttgctttatggcctaggttaagtcacttatatctggcttttaatttcctaatctacaatgaaatatgttgaatttaaacagcagttttcaaacttaagcatgcatcagaatcacctggagggcttgttaacataaattgttgggacctacccccttgagtttctgacacaataaggtctggggtggggctcaagaatttgcattcctgacaagttcccagatcatgttgatgctgctatctgggaatcacactttgaaaaccactgaatgagaactatcctaagctgtatcagacaacagatcagaacttctgcagatagacagaaaagcacaccaatgaagaactacttacaaaatctatgttgaatttagagaactgtatccgcatgtggaacaagatttctaaatattactgtggtatggggtgttttgcactatctctgttttgacctctaaattttgcagtcaccatagtcacttttgcaccccctgtgtggcaactgggttgtagtgtttctaagacctacttctgggctgagagggagtttccaaaagaattggagaggtggaaaatccccatgtcccaaaccagttgtattaggtttcactgccctagttatgacattggaaatagctattctaattactaaaaactatgcaccaaaagaaaaatgtgattctggcagagaaactaaggcagatgagaaaatgcaagaatgtcaaagtaaagccagttaggctttgtggtaacacacaggcagttgcgtgatttccctgtgctctttggaaacctttaagaagtcagaaacaatcatgctttccattaattaacaacacagcatcttgaaatgcttgttttaaagccaggagatttccggttcatctgcagattatagtagtatgcttctcagcaaaatccatctaatagtaaacattagagtctttcaagttattaaatacgcataggttgttaagtaaattttaaagtatttgttaaatcaatcaatgagcaagaatgcaaacatacctttttttctctcttcaatgagctttcagtttagttaaaagggagaaaaggtgcacgctacagttagaacaattgactggtaaactaaatggtactgaattaaatttagtgtgaatacagaaaaagtagaggttagtatgggctggtatagttgaagggacaagagtggcacttgagatgggtgttaggatgaagaaggccaaggaagggactcagcaaaataaaatagcttcattaaaagccacggaacttgggttaaacacagtgctagcctgtaggtaaagagagatgttggggatttttgaatgaccaggttcatccatccatacatctaatcctctatagttgttcattcaaagaacatgtatcaagagccaactgtaagccagacactatgctatggagtgccttgccaattagaatttggttaatgttttgacaaaggcaaaagaatttggacttaatgttatggatttaagcagacaatgacatgatgaaaacctttttttaggaagattacccaggcaacaggatggatggtacttcctttttttttttttttttgagacgaagtcttgctcttgtcccccaggctggagtgcaatggcacaatctcgactcactgcaacctctgcctcccaggttcaagagattctcctgcctcagcttcctgagtagctgggattataggcatgcgccaccacacccagctaattttgttatttatttatttatttttttcaatagagatgaggtttcaccgtgttggccaggctggccttgaactcctggcctcccaaagtgctgggattatatgcgtgagccaccgcgcctggccctctgcttccctcttttctaatctgatggttaagcccttagcattcccttgactctggaacttttgcagagcaaagagcagaggctgtttgaagccagctgcatttctagacttttatgaaattctaagcccactgcaaagattgagccagatgtcccattggggaagagaggagagagaaaagtttttgaagtcagcgaagaggagagagtgacatttcacacagatggaaagagactggaggtcaaagagtaacaagtacccacctccattccatatcagtgccctggagaagcagcaggacctcagagagggaagtaatggggtgacttggagaggctgcactttagcaggggattctggctccataaaaggttaaatatagcaagcttctagggttggcaaaaccatgcttactgaggcaggggtggtttagtggcagatcaacgatcagagtagtctccttggtgctttggtaccaggtaaaacctagggacctttaaatagctgagaaagtagggagaggaggaaatatcaaacgtatgaaattgaatttctcaccatcctgattcagacaggggctttaaattgatgactaccttagatttatgaactaagagtcatacactatgaacttttgttcattggtgctcagtcctagacccttttcacctctctattctcttctggtgtcatctcatcctttcccatctttataccagtggcttccaatttatgtttttattgtagaattctcatctgagtgccactctcaaatacctggttacctatttgatatctgcatgtggatgtgtcatagacatctcaaaattaccgtaggaaagactgatctcctgactgttgtcttccccttgtttaaagtgcctccctttcctcctaatactttatatgaggagtcagaaaactatggactgtggaccaaatccagcccccacctgtttgtgcaaatacagttttgttggaacacagccatgttcattcttatgtgttgtgtgtggctgtttttatgcaacaatggcagaaactttacagcctgcaaagcttatttactatctggccctatacagaaaaagtctaccaattcctgctctttgctttcttcaatgtatttatcacaatttgaagttatatatttgtttcattatctgcttatttatctgcctccttccatagaaggtaattctctagtgcctaccatgacagcaccattgcctagtcatggtaggcactcaattgttattgaatagaatgtatgaatgagaaaatgaactattatatattaaaattttattttggtcttttgccttagcacaaaactttcatccttccttaccctccaatgacttcatatctttgttttgttttgtttttttctgagacggagacttgctgtgttgcccaggatggagtgcagtggcactatcttggctcactacaacctccacctcccgggttcaagcaattctcctgcctcagcctccccagtagctgggattacaggcacgcgtcaccacacctggctaatttttgtattcttagtagagacagggtttcaccgtgttggccaggctggtctcaaactcttgacctcatgatcctcccacctcggcctcccaaagtgctgggattacaggtgtgagccaccatgcctggccctaatgacttcatatcttaagtaacaagagtgctaaaataatgagtcccctcaatttctttgccctctactctatcctcctttcagattaatctttctaaaacagagctcagatatcactctccctcaaagaaacctggagacccaatgacttgtccattaatcctaaacttctttacctgcttcttaaagttctctgaatctggctccactctatttttctgtccccctatattctattcctgctactacttctctaccctgaacttccccacctctatacttcatacacttggaatattcttttctatcactaccacctccacctatcaaaatcctatccacccttcaagtatttcctccaagctgcctttctgagtaccaccaaaagacatctttctcttcttccatcttccaaaatacttttttgtacctatagtaacttgtatgtcatttctccatactgcgttctccccattagctggtaagctacttaagaaaaggaaccacagctttctcatcttggtatctgctatggtttgaaagtttgtattcccctccaaattcatatgttgaaatcctaacccccaacataatggtattaggaggtgggggctttgggagagattagtgtccttataaaaagagacctcagagagttagctaatcccttctaccatgtgaagacacagcaggaaatccataaaccagaaagtgggccctcaccagacactgaaaatgccagtgccttgatcttggacttcccagcctccagaactgtgagaaatgaatttctattgtttataagccactcagtctatggtattctgttatagcagcctgagtggactaagactgcttctgaagtatttggaacagtatctttctagatctcaataatcattgaatgaatgaataaagaaatgcctttccttttcatatctacttggtaaaatcctactcattcctcagagaccaaaatctttgcttctgaccccagtccatgatgatttttcctttctgtactgccttgtatttttttcatcagtgactttctcctattgtaatctctagaaggtagagactaaatcctgcacatctttgtgttcttcttccttcacctaacagtaccttgtgcattacaagtgctcagtaaatatttttgattaagttgtaaagcagctgcctatttttccacttcctttgctgctcaaaaggattagagcaatgattgctttagctgctaaggcctgcttcagagacacattattaatgaaggttgtctgggagacagtaatgttgaacggggatttgtaaatgagtctccagcttcaacattcatcagcaaaagaaggggatactgaaaagctactctaaaaaaaaatctcatatgaagttgtccggagctgcctgagctactaatcactgcaaggttttcagtctctgccttgagcatttagagcacattcttgccttaacctccaagtcagatctctccatggtaacgcaggaatgtttgctattttaggaaatatgcctcactgcatgcagtactatttacattaagttccaaacaaggcataaatgcaacagcttgactgtgctaatttgtgtgagtgggaaggtctcacttacttaatgtgggcctctccctaattgtgttatcctgtctcattttataagccaaccacagtgagattacatgttaataaattttgctcatcttatactgaaggagaaatgcagagagagaaaaaaggcgacaaacaaaacaagaattcctccagacctccctttgcaagggcatcattttttctgccttcacaccctccaggtctggtttcatttaaaaccttcattgagatgaagcttctaacattctgtagaaggaaataatatcaataactgaaacaattgctagcttttccctgcaactttgtagatacctttactgaggaagagaaaaatgctttgtaaactttattagattttctgactccctagtgaaaaagatgtggacaagatgtcacagcctcacatcaaaaagctcctcaacactctgatcacacatactattgatctgaatggacatcaagaaggattggaaggagatatggaatgatgtcagtcaatggcatatctagttggtggtactttttttgctttacaagaagttaattatagacgttcataaatactgtgcaagtgcactcccactaaaatgaatgttgtagaatgttttggtagaatggaaaaggaaaacagctagaaagactgtaagatcaattaaataaaataatctttatcaaaagtgtctgtcttatttgagagaatgaagactctgaagtgaacttcctgtactcagatattacagtgagtatattatactcatactccagactttcatactgggatcacttgagagatagttatctgtgggatgtggagtaaattagcgttcttcacttggacaattcagacctagaagtgcaagatctgtgagctcttctttcttctagggcccaactgtttgtggtattctcagttgtgaagtataggtggaattaaaggaagtgaataggtctttagaacttaagctcctccatactccagctgaatcagtgagggattccagggatggcttcactggagatgaggagattctttagcctctgaagaacaggcccagagcttagaaattgaacttttaccttccacattgtaagggtctttcttctgtggtgacagttggcatggcagacaaggtttgagtagaatacagtggaactataactgttacagtgaaagtatactgttagcagagaaggataacacccacaacataggctccaagtgtcacaaatagcaaggttcaccatacattacctatgcagaggggagagacaaagtgctttgtaattggttttataatattcttttccccaaccaattcaaagaacagacttgacaaagcagttcatagctgtgtcagattatgatttgctctctgaggaggtgacatcaattatctcagatgctcttcaagcaatcctcagtttccacgacaactaggattacctttctaaatgcaaatcatatgcttttattccccttgctttttttttttctggtgcctacaacatgaagcccttagctcaacatttatggtactttccagctatatattttatcattctccaatacttatttttggtaacatcgattactcccaattccttagctgtgttccacatcactgtatatattgctccgtttcctattttctgcctggtgtatccagtctttaaggcccaacagaagggtgacctccaggtgagttcctccttggagttaattcctttcagctgtgggttcctttagcaccatgcgtgtatttctgtctcctcatttatcacactgtattttagttctttgtttacataccagtctttcactggactataaacctttggaaggctaggactccctatactagtggtactcactgagcaactgtctcatctcctagagagcattttgaaattttgtgggggtgtttcttgtttttgatgttgtcacgatgataagtgaggcaagggatgttacaggacaaagtattgtaccaaattccaaatgacttttggaatttgaatgttccattgggtgatgataaaactgtttacaatcatctgaacctagaactttatataggagcatgatgttaatttacactaaatttttccatgaattaaactactatgtaaattgagggaagacactaccagtccttgggcccaattttttttcccataagacgtagacccaaagggagaaacaaggaaatatgctatgggaggctttctattctccacacttgagaggaccaactatcagcggcctcctgtggcagagctttccaacttgggtattccagcacagtgtacctcagcatggtccaccactgtgcaaagatgctgatcccctcagctctcagggtggtgcatgggtcctgaggtggccataagcaattgcctcaaaccatgagcagccatgggcacttatttcagaataccatagatgtacactcatttcctatgaaaatgaattttctatgaaaaagggtaggaaacattgtcttatagaacaaacagcgcaatgtatcaggttttgaaatgtacaacgtattgggtaataacaacaataaatttttattaggcaatgtttaaaaagcatatcaatttagtacagtttatatgatttgatgcatttcttctgcccaatggtcatgcaatattatcccctggatgctgtacttattcttgttctaagcatccttttagagtagaatataaataatttagtctctttgaaattataatcttttggttctttaagtctgttctgaaaactggtaccaaaccaattccttaattagcattgaaaatactgaactaaatatattcatttcagtgcttaccaaagatgatgaaaataagtatatgtacaaaatattttagtatttatgtgcctgtaaatacaaaaggagcaataaaagtgatttcatttcagaaggtgaacattttgaaagaaataatattcatgtaaattctgaactaaaatagaatgaaataaaattctgaaataagataaaaatagaatgttagcattataggaaactatagagattatttgagctaatcttctcattttatgtatatggaagctgagaagtgacatatccatagtcatacagctaataaataatcaggatggaatcgcttctcggccttttggctaagatcaagtgtagtatctgttcttatcagcttaaataatcaggatggaaattcaattcttcttattctcagttgagctttttctaattaaatgtattacgaaatattttcaagagtcccttaagaaaatttccacatatttcaacatgtatcttgcaaaaagcctatgaacttcaatttgtattcatacttgtaaaattatgttcacacattatttcttgagtttgttaaccaatgctttccaaccaaaatggagctgcagtctaagaagtttgtaattgtggccaagatagtaattttttcctgccctcatagtggcctaagcacccaaattggccacctccaagtgagaagcttcatccatttacctctataccttacaaatattatcatttgccatgaaatggaaaggttgggaagcagtggtttaaactaattcttatcattgctcttttatcttgaccccaacctttccatatgtgaaccagtaaagtaaaccacccacattttgtcttatcagtagtctaagaccagtgcaagaatgtaaggataccaggtaattgcttttgttgtttgggtgcaggtatattctaaagttcttttagaaaatatctttttagtaaattaaaagttgaatgaaggagaggagttcccttcgaggtaacttcccagaaaatcaatgcaattattttttaccacagtgagttctcttttcaatattaaaactacattatggccaggtgtggtggctcacgcctgtaatcccagcactttgggaggccaaggcgggcagatcacctgaggtcaggagttcgagaccagcctggccaacatggtgaaaccccatctctactaaaaatacaaatattgctgggtgtggtggcatgcacctgtaatcccagctactcgggaggctgaggcagaggttgcagttagccgagatcatcccactgcacttcagcctgggcaacagagtgagactccaactcaaaaaaaaaaatttttttttggaggcaaatttctatcattatctgatacacttggacggaaatagtaatcaccatttcaactagtacccagcacattttcaaggacctggaaggttcatactccaatatatacaaacagagaatatgcctagctcatagatgatcaataactgtttatttgaacccatagtttgtgtacttcggcacagtattttacaacttaaccctcaaaaaaacccctaaaacattgtatgttctgtataattataaatcacttgatgtggctggcaaattctaaggtggtccctataattctcacccactggccatcacatctttgtgttatcctcaccccttgaggatgggtagaacctgtaacttctaaccaatatggcaaaggtcatgaaatgtcactgcatagttatgctatgttatatgaaaaaagtaaagaggtcatatagatgtaattagggctgctaatcagttgattttaagttaacgaaaagggatattatgctggtgggcctgccctaatgagccccttaaaagaaagtctagaagtgagaaaagtaacagactctttctgctgctggctatgaagaaggaagctgccataacttctacagctacacagcaataaatccttccaacagcctgaggagcttagaagccgatccttccctaggtatgcctccagatgagaaaagagcccagtctacatcttgatttcacacttatgagactccaaacagatctcagctaagccatatctggactcttgactcacagaaactgtgagataacaaaaataaggtgttttaaactgccaagtttgtagtaatctgttacacaacaatagataacaaatacacttagatattaaaaagcagggcttatgaaagcatgaagcaagtgcttctggatgtactgaccaaaccttacctgcacttccatgctagttggctcctccaacagatgtagcagttgttgtttctcccgagatagctgttctacaagcctctcctgggcagccaggctctgattcagttcttcaattctcctgaagcaaaggaaaagtaaggacagtaattatgatcatgatactattattaccttattttttcagcccattccaaagatagcatggtctagtatagcaggtttttatccttttggatcattgaaccttttgacacatttgtttagaaaaccatgtattttctgcccagcccccaaatatatacacaaacaactttttgcttacattttcaccacgttcatggacctcctgaagttaatccatggatctttagaccataggaatttaactcttggaataagggcctagaattttttggtggtggtggtagtggctgttccattcaataaacggttcttggataactattttgtgtactcaatgcactctaccaagtactggaaatatgaagttggaaaagaaacaatcgctgttttgcaaaaatttaaattccaccagcatgtgtttgctagtgatttggagagtaagaagacatacagctacagtcacgtaccatatactgtttctgtcaacattatgtcatcatactgcatgtatgatgatggtccaataagattatactggagctgaaaaattcctatcacctagtaaagtcctagctgcagtaacatcatagtgcaatgtatttctcacttgtttgtggtgttgctggtgtaaagcaaacctactgcactggcagttgtatacaaatataacatatgtatagtatgtaatacttgataataaatgttactggtttatgtatttactatactttcattgtcgttttagagtgtactctttctacttattaaacaaaataactgtaaagtagcctcaggcaggtccctcaggagctattccagaagaaggcattgttatcataggagatgacagctccatgtgtgttattgtccctgaagaccttccagcggacaagatgtaaaggtggaagacagtgaagctgatgatcctgacactgtgtaggcctaggcttgtgtgtatgtttgtgtcttagtttgtaacaaaaaagtttaaaaagtaaaaaaaaaaaattaaaaatttaaaaacagaataaaccttttctagaataaggatataaggaaaatatttttatatgactacaaaatgtgttttaggccttcacattcatccacttcactactcactcgctaaatcacccacagcatgttccagtgctgcaagttccatttatggtcagtgccctaaacaggtgtactgtttgttatcttttatacagtatttttactgtatcttttctatgtttagatacacaaatggttaccattgtgttacaattgcctacagtattcagtacagtaatatgtcatacaggtttgtagcccagaagccataggctataccatatagcctaggtgtgcagtagcctatcccatcaaggtttgtgtaagtatgctctgtgatggccacacaatgaagaatgaaattgcctaaagatacatttctcagaacatatccctgtagtttgtgatgcatgattgtatataagcaaataatagtaatagaatataataaatgctaccagaatagaggcaccatatagtacattgagtgctgccatagagctataggatgaaagataaagaaataattcatttgacttgaaggagtatagcgatgctcaggagaagaaattttaaagattgagtggtttcagagtaaacagacaacctacagaatgggggaaaatatttgaaaactatgcattggacaaaggtccaatatccagcatctataagaaatgtaaacaaatatacaaaagaaaagcaaccccattaaaaagtgggcaaaggacataaacagacacttcaaaagacgtacctgcagccaacaagcatatgataaaaagctcaataacactgatcactagagaaatgcaatcaaaaccacatgtgataccatctcacaccagtcagaatgactatggttaaaaagtcaaaaaataacagacgttagtgaggttgcagagaaaaggaaacacttatacactgttggtgggagtgttaaattagttcaaccactgtagaaagcagtatggtgattcctcaaagaacaaaaagcagaactaccattcgacccagcaatcccatttctgggtatactcagaggaatataaatcattctaccatgaagacatatgcatgcaaatgttcactgcacactatttacaatagcaaagacttgggtggttttccaggctcagaaggaggagattgaacaaaggaacaaaggcatgaagacccagtgtacaatttgggaagagtcactggaacaaaggcccagggaagaggcaatggctggagaagagactgaaaattcagaccctcagactagggttaagttgtaaaatactgtgctgaggtatacaaactatgggttcaaataaacttattgatcatctatgtgctaggcatattctctgtttgtatatattggaacatgaaccttccaggtccttgaaaatctgctgggtactaaatgaaatgtttccagttgtgattctttttttttttgagatggagtcttgctctgtcgccagactggagtgcagtggcgcaatcttggctcactgcaacctccacctccctggttcaagcgattctcctgcctcagcctcccgagtagctgggactacaggcatgcgccaccatgcccaaccaatttttgtatttttagttgagatggggtttcaccatgttggccaggatggtcttaatctcgtgatccgcccgcctcggcctcccaaagtgctaggattacaggtgtgagccatgattcccaggagaaataacttttaaaacttaaaaacattgggctgggtatggtggctcatgcctgtaatccctgtaatcccagcactttgggaggctgaggcaggcggatcacctgaggtcaggagtttgagatcagcctgaccaacatagtgaaaccctgtctctactaaaaatacaaaaattagctgggcgtggtggtgcacgcctgtaatcccagctactcgggaggctgaggcaggaaaatcggttgaacctgggaggcagaggttgcagtgagccgagatcttgccactgtactccaccctgggcaacagagcgagactccatctcaaaacaaaagcaaaaacagaaacaaaaaattaaaaacattatacaaatgtaaactgcaatgatgacgagaaggaggaatgtggactccatatgaaattccctcatggtatctgcactagaacatctctacttttcttaaacctcaaactttgctcatctctttgacccttagtctccacagaggatctgttctcctactctccaaaattgttcaaggtcatctgatgagtggcctcaatttattttcagatgtgcatgtgctttacttggggttttgttttggtttttagttcagtttttttttattggggttcaaatatgacactgtcttggggaacctagtagggaaaatctgaaagcaaatacagtaccatactgagaattgtacaatatgtatatatataaaagaaacaatacagaaacttcattctgctatcacaaagccttcaaagaaatgacgattgatgccttagtgaggttcactagaagggaaaaagttggcagatgtttcccacagaaggaaaagcatgagcaaaattctggagacttgccatagcttcttatgcttctggaggcagtatggcttcagggtttggatgtcagcaatccctgaaaccatgtttcacaagtctccagatgccaattttttcattaataaagtataataattcatatctcatggggctgttaaacaagaacataaagtactcagctgtatggtaagagctcaacaaagcttagccatcattattattactagcctggcatgaatgaagttaaggaatggtggtgggtgatgagtgtgggagaaatcagaggttacatcataaaaggctttgatggtcacattaggagtatggatcttatctcctaaaggtattgcaaagcttcttaaatggctctgccatggtgcgattaaatttatgtcttggaaagatcacattggtcatggtatgcacatgtggtttttgcctattcagttaaaagctccttaaagctttttataccaccacagtcttatgcacctaagaggctaaattatttgccaatttgttgttgttgaattatctatttcagaactactctgaattattaggttgagattgaatgagaggagcaggactggaagtggagaggacatttagaaagtttcctcggtaatccagacagtagatggtggtgacctcaataattgcccagttaccttcaggacaaagtccaagttccttataatggtatacaaagctggcacaatcagacccctattctcaaaacagcttacctctcacttgtcttctcacttgctccagttatgtacaattatttaaagttcttgaaatattcctttccctgtgtcttccctccatagtttctccttctgcatagaatatttcctttccctatccactttctacctatttattctacctcctattcatccttcaaagctcagctcagatttcgcttcctctaggaaaacttcaatggcattatcttagtctttttgggctgctataacaaaacaccataaactgggaggattataaacaacggaaatgtatttctcacagttttggaggctgggaagtcctagatcaagtcactgacaggttcaatgtctggtgaaggttcacactctggctcataacggtgcattcccactatatcctcacatggtagaatgggctaactagctctctggggtctcttttacaagcgtattaatcccatttatgagggctccatctccaatgtctatgatttaatcacctcctaatggctccacctcatactacttctggaggcagaagtattaaccttaagggttaagatttcaacatataaactggtgggggagggaggtggggatgggacacaaacattcagaccacagcagacaacttgctcttttaatgtggaatggatgaccctccaatatttccccagagcaccccatgctcttctatcagggaacttattaaaatcatgtaacatgtttcttggtgacaagaattaggtcttttgtttctgtaacacatgccagatacttagcccggtatctggcatgtggcatgcccagtaaatgtttgctgaataagtgaatctatgtctcttgcttgccgctatttgcccactgaatccatgaagtgagttttcataatggataccactgaaaattcaaccctgaaaagaatgtcttcggttgtgggcccataaagtcttagaaatagtgaagctcctactgtcagtccttgaaagggaacaggacagctgctgtatgccttgagaatgggcaaaagacaagcgacaaaaagagcaccgaaggcacctacttgtccctctgggccagggcctcagtgtattggtcgggcttgacctggtctcctggtacatcttcccagtttttggtgactcccttcagtttctctgagagctccaggttacactccttctctgcttccaccagagctgccatccgcgcagcttcattctttgctagcctggattcctggaaaaagaacaaaaactgagaggctgcaaaatttctacctagattaggagccctaagacccaggaacattgatgaatttcagagggaaagtagagacggaaaaggtgaatgccagaaggcagagcagtaggaagaggagtgttaataaaagagaacccctacctatggactttgggaactcctcacctcctgcagaagctggatcttattctccaagagctcataaacatgctccgtctcctgctgtcgctcctcaaactggcgtcggagctcagcttcattctgactgttgagattctccacatcagccctaaaaccacagagcattagccaatcagagccagacatacagtttagcaagtggaaccattaaggttgttctttgataaatctccaaactgctttctgcagtgactgaactggtttatatttccaccaacagcgtgtaagcattcccatttctatgcagcctcaccggcatctgttgtttttagacgttttaatagtagccattctgactggtgtgagatggtatctcattgtggttttgatttatatttctctgatgattagtgatgtggagcaatttttcatatatttggtgggcatttgtatgtcttcttttgaaaagtgtttgatcatgccttttgctcatttttttaatggggttatttgtttttcattgttcaattgttaaattccttatggattctggatattagacccttttcagatgctagttgcaaatttttttagattctacaggttgtctgtttactctgttgatagtttcttttgctgtgcaaaactctttagtttaaataaatccgacttgtctctttttgtttttgttgcaattgcttttgaggacttagtcataaattcctgaggccaatgtccagaatggtgtttcttgggttttcttctaggattcttatagtttgaggtcttacatttacatctttactccatcttgagttaatttttatatgtgctgaaaggtaggggcccagtttcattcttttgcatatggctagccagttatctatcccaccaccatcgaataggggagtgctttccccactgcttatttttgttgattttgtcgaagatcagattgctgtaggtgtgtagctttatttttgggttctctatttgcttccattggtctatgtgtctttttttttttccagcaacatgctgttttggcaactgtagccttgtagtatagtttgaagttggatagtgtgatgcctctggctttgatcttggtcatttgatgaatgacattggtagtttgacaggaatagtgttgaatctgtagattaccttcggcaatatggccattttaatgatattgattcttccaatccatgagcatggaatgtttttccatttgtttgtgtcatctatgatttctttaagcagtgtttcatagttctccttgtagagatctttcacctccttggttagatgtattccaaggtatttttttttttttttagcagatattgtaaatgggattgcattcttgatttggctctcagcttgaatgttattggtgtgtagaaatgctactgattttttttttttgagacggagtctggctctgtcgcccaggctggagtgcagtggcatgatctcggctcactgcaagctccgcctcccgggttcacgccattctcctgcctcagcctcccaagtagctgggactacaggcgactgccaccacacccgcctaatttttttttttctatttttagaagagacggggttcaccgtgttagccaggatggtttcgatctcctgacctcgtgatccacccacctcggcctcccaaagtgctgggattacaggcgtgagccaccatgcctggtgaaatgctactgatttttgtacattaatttttgtattctgaaactttattgaagtctgaaaatatttttaataattttagtaatacttgtcatttaacactaagcttttaaaaaactgtaaattataaaagtaaccattttagcaatataaatgtatataaagaaaaatatcaagtcttctccctatcacggactgtgatctcactcttcctcagtatactataaatatcactcagcaacttttcccccttactttaatcaaggaattcccactaggacaataatatagagctaactcattcttcaataactgcataatagtccacagtgtagtaataccaaaatttattcaatcaatgccctattgatggataattgtttctagttttttgccattacaactaatgatgcaataaacatccttatacatttatcctttcacactaacgcttttatttataagaaacagattccttctcgggattgtttgatcaaaggaaatcctccttttttattataataggtagcatcccatactaaaaatgttgtcacaatttacactcactggtagtgtatgagagtgcccattttccccaaatgttatctcagctcttgatgttattataggctgactgatactttttgataaagcttatttgcatttgtctctactaaaagtggaaacattcactgtttcaatttagttgattgctgactgataggaagtttgcagtcttaggtctggtggatttaccaacttatgacaaggtccatctgacctagtaatagagaaagagcccaagggaaacacagcatatgaaaatctattgtttcagttcctgaatcagatacaggattcaaatgccacagataggttaaggaatttggttccaaatctattgctctcagattagtaagacagactctggaaaggaccagagcttaaaattacaacttaccatgttttatccagatgctgtttcttgtcctggagttctcgtttcaagctctccacttcaaccttcagctcaatgttctgaaaaacacacaggcattaatcgttattaactgccacagacactctttcctggatccaggttcctatttgagtcttgccttggtccacagcctctcacctcatctctgccctctttgtgacccttgacataattagggatttagttggatcagcaatctagtcaaggaagaataaactgtacagcttcagggtttcccctgagctacttatcaattttcccaacctatttatcattacccctggatcatgaacactgcttaagtctattcgttctctaaaccattgcaggacagagtatatattaaaataaatttttcctatctaatacaggttgttcctgaaaacgaaattgctggaataatacttttaatagaattatagtaatagaacaatacttttaaatgtctggggatttaattatttaaagaaatttggttgtaaacatttttaaaaacaatgcttttatcataaaattggaattttataaattaggtttgcttaaggtgagaggggactctgatggtaaagttatacagggaacaattaatttttattgaggtgaggatgcaacaagtaagatttggggaaacagaaataaggaaataaaaacatcccaagtgtgtctggtgcaggttaagtggcttagtgtgtggtaaggagtatagaaaatagtttgcaactagtttgtgaaaatcctgctaagacaactagataggccggccacggtggctcacacctataatcccagcactttgggaggccaaggcaggcagatcactcgaggtcaggctttagagaccagcctaaccaacatggtgaaacctcatctctgctaaaaatacaaaaattagctgggcgtggtgacatgcgcctgtaatcccagctacttgggaggctgaaacaggagaatcgcttgaacccaggaggtggaggttgcagtcagccaagatcatgctgctgcactccagcctgggtgacagagagagactctgtctcaaaataaaaaaaattaaaaaagtaaaaaactggataataatcagtagaaatcaaagacttatcagggagctttaagcaaagtattggcatgatcgggtccatgttgaagaaggaattatgaagaaggtgggtgggtcaggggcaactaaccagaatagggagggggactgtctaaggacaagaggtacagggagaaagactcaaaagacatttcagagacagaagccacaggccttgatgacttgtgagattcagattagactggagggaggaccaaagacaatgctgaaatttccagcatgtcagtgggaatgcattctattaactaaaataggggcaggtttgtaggggaacctaaggaggtttctgcaaaatgttaattgagggattactttatttcagcttaaacgttagcatgcaaagatggattagtcccttccctgatgaagtccataatacagtattaggcaagaagaatgttatttagtaaagaagtctttagatcagaggttgacagagagactgaaggtaaagtagctaaagtatgaaaagtagtattgtgggtactagaacagtagggaggattttactttactatcgccatataataaccaccaacacctagacttctagaagtccaaggcaacatacaatagcagcatattttctaccatacttgtgaaggcatttcataacccatgtttccatgcagggtggtcgaaacacaaatactaattgggaaaagtagaaacctagtttagatatttgagagttacttagaattaaagaattttagagctggaaggcagttggactcaaggcattttagatcatattactagtatgtttttagtgacatactgagaagaatgtttgttcccctcataagtaggtaccttttgaccaaggttagaacatagattcagatccagtgagatgaaaatatcctaatttcttcaaaagaaggaatgatagccctgtcttttcaggatatactttaaagttattattttatgaacactaaatagcattaccagatttagcaaataaaaatataagatatctacttcaatttaaatttcagataaacaacaaataatttgtttcattagaagtatatcctttgcaatatttgagacataacttaaacgctaaaacattgtttgttgtttatctgaaatttaaattgaattgagtaccctgtattttattctgcaatacaaataccaaaagattaacaaatggaaacacgcatatttcaattttgtatgaagaacaagtctaagatctctatatcagttccatggcctggcactgcaagaataattcatctgtaccaattgatgaatcagtaaaatagaagatttgctaaacagttgctatgtccccagctttgtggtcaatacttaaaggaattcaaatgtcttcataaaaaatagtccctaagctagaggcccttcatagaggtgaaggaatatgcattcaattatgtgggaaatgcaaagagggagcaacttcctaatctgtaataggcagataattgtattttcctcattcataaacctacctgagaggatcgtgaggcataaataaatcaatacatgtaaaggacttaggacagtgtttctaacacaggtataactataattttaattataataatattattatcaccatcatcatcaagaacaacagcattatcatttggaacagcagtttgctttccatgagaccataatgtttcaagtggattcagtgttcaggatatggtgctgagaaagaggactcctaagtttattattatttctgccaccaattgattcacttctgtgaccttgggtaaaattctgctaaggcttctccacctggaaaatgacaaagagtgggcaaaaagctatttaaatctcatatgaaagaaaatggaatctataattatgaagtgttattatcaatgatattcctatgcctggctaatttatataaatcagaaaagtctggatatgctaaaccacctcagataagccaaaactgcttgagcagattttttaaaaatctcatatctaaaaatacgtgaggtctcaaatgactggagctatatggatgtcctctgcctagttcttagtctcatgatgtgacatagggaatctctatcaggtataaactgatcaacagaaagttccctgaaaagtcccttactattaatactatttttgcatgaggaatctttgaatattcaaataaaaataaacaaacaacagggaaagtgagaggcactatgaaaccaacctaaagccagaaagaattaggttcgaatcctggctctatcactttcctgctaggtgaccttgggcaggttaactaatcactatgagcctcagttttcttataagtatagtgtggttgctttgctttttaatgaagataagtattcacgagggattctgtgaggattgaatgagacaatgtgcatgataagcatagaacaatgccttgcacacagctgtgcaacaaccttgattcactttcccttcatgtccaggctgactagtgccagtcagagaccccagccttaccaggaaaaatacttagatctaaaaggaagaaaaacagaggacataaattagtacgttctatctgttctaaatcctactgaagaaaatgaagtcaatgctttgaccaatttggccaaagattcacagatttgaagacctcagcatttctgtgttctagttctcttagtttaaagacaaggaaattgaaatccagaagggttacctccaaggtaaaagccgtaactgaaaccaacactccactcttgctttagccttttatcagagagaccagcttagcaaacactgcccagttttgtctgattttgtagaatgtggtaaattatagaattagagaatgtgctgcatttagtcttgaaagaatatatggaggcagtaagtatagtggtcaagagcataggctctgaaggcgagaagggggcttgacaagtcacctgccctctctaagagcctcattcacctcatctatcaaggagataacaatgataccaatctacaaaggatgttagggagactaaatgaaattatgcacaaaaatcacatcgcacagtgcctggcatgcagtcagtattcagaaaatgataactattattaactataaaaacaataacaatttaccctctctaactaggatagctgaaatccagaagggttttcaaggtaaaagcaataatcttacatcaaagtctaaccttcttgcaccttctttctgtagaaaaatcatcatatagcttatcacatttattcattctccattactaaatattcatgtgtaaattgttaaattcttttatagcatcagtagattccaaattaactgcatttgcttattttatcaccaagtcttcttggctctttgtcaagatatctaaggaaatttatgtactcaagaaaggggagatgggaagaaagcacttctctttcttcatgcctccaaaggagtgttcgcccatctaactcaagaaaaagtttcaatgatgaagctgaaattaaacttctattaggtatttcttccttctccccaggactggagtacatgaatagtctcatatctggtttccccaacctcagtccctctactacttaaatttttcctaaagcatagctctggttatttcattccgtctgttcaaaaagcatttaatatgtgatgcaggtccagctaaagaagaaaaaggaaagaaagaaaaaaccttttaacgatttttaactgtacagcgattaaattatacacaactggcctgataatagagtctattcaaaatttgacctcaatctacctctccagctttatcttccattattatctgctagcctaactggatttcccaaacatgccctatgcttcttggtgccacatcattgtgtgcccttcagcttcatggttaaatgctccgtcccctgtgaagccttactttatctctccaaattaaaagtaatttctcatgatgacattatgagctttcaaatattcttttcatactgcaacattggcatcccgtgtaaatgcttcatatttctacacctgtcttatttacccttttaaattgcaaactccctaaggacagaggaaatgatggtgtggcagaactacccaggtgcgctggttattaagatactgcctctcagcgttgtcatgctggggcaggaatttcaggataagtaaacctaggttcacatacctttctgccacttcctaactgggggaccttttttgtgtaaattacttcaacttttacaacctaatttcctcatttataaaatagggtttgcaaaaattacctcaaagtttgtagtgaggaataaatgaatttatgtaaagtacccagcacaatgtctgatacaaataaccgcagctcgggcgcggtggctcacgcctgtaatcccagaactttgggaggccgaggcgggcagatcacgaggtcgggagatcgagaccatcctgcctaacacggtgaaaccccgtctctactaaaaatacaaaaaattagccgggagcggtggcgggctcctgtagtcccagctactcggaggctgaggcaggagaatggcgtgaacccgggaggcggagcttgcagtgagccgagatcgcgccactgcactccagcctgggcgacagagtaagactccgtctcaaaaacaacaacaacaaaaacaaataaccggcagctgtgactaatctgaggtctcgcagtgtctctcacctctttgtgcagtaaaagctttgaaagagtgaaccaacaagagaacaaagaaggaatagatgacaagaggcggaagtggactaacaatgatacgtttgttgaatgagtgagaaggtaatagataatgctgtgagattatgtggaaaactttttatctgaagtctttaaaagacattctcacttttggctgggcgcgggggctcacacctgtaattccagcactttgggaggctgaggcgggcggatcacttgaggtcaggagttccagaccagcctggacaaactggtgaaacgctgtctctactaaaaatacaaaaattagccaggcgtggtggtgggtgcctgtaatcccagctactcgggaggctaaggcaggataatcgcttgaacccaggaggcagaggttgcagtgggccgagattgtgccactgtactccagccggggtgacagagcgaaactccatctcgaaaaaataaaaaatgtactccagctggggtgacagagagaaactccacctcaaaaaaataaaaaataagggccgggcacggtggctcatgcctgtaatcccagcactttgggaggccgaggcgggcggatcacgaggtcaggaaatgagaccatcctggctaacacggtgaaaccccgtctctactaaaaatacaaaaaattagccgggtgtggtggcgggcacctgtagtcccagctactccggaggctgaggcaggagaacggtgtgaacccaggagtcggagcttgcaatgcgctgagatcgcgccactgcactccagcccgggtgacagagcgagactccatctcaaataagtagataaataaagactttctcaggtttttgttttgtttttgtttttttgacagtcttgctctgtcgcccaggctggagtacagtggcgcaatctcggctcactgcaagctctgcctcctgggttcatgccattctcctgcctcagtctccgagtagctgggactacaggcgcctgccaccacgcccggataatttttttgtattttttgtagagacagggtttcaccgtgttaggcagaatggtctcgatctcctgacctcgtgatccgcccgcctcggcctcccaaagtgttgggattacaggcgtgagccaccgcgcctggctgactttttcagttttaagctaagaatattctctaataggtatattattgacccattgacaatagaagattgaatacactttaggattccagcctcctcttctactgctcatgctctccgtaagaagggctaaacatcctactcctgtgcactacattggagctcagaaatactgacttaaaatctccagatcttaacacggacttttaaagggaagattgagtatggacccagtattagatggtattatggaattatttttaagctttttgggtacaataatagtattgtggttatgtttaaaaacaaagccttctctgtgagagttatattctgatatcttcccaaataaaattatatgatgtcagagagttgctgtaaggggtggaagaggacaagatggagaacgaacagtgcagggagatcactgaaaagaacagcaaaatgttgggaaccgttaaagctgagtgatgggaacatggctccctggtaaatgggacacatacatcgggaggtactattttcgtagtctttgtttatatttgaaaattttcaaacttacataatgagaagtcaaaaggggcattttcatcccaaaaaggtaaatgtccatattcttttttattttttcattttcatttctggaattacctaaactcaggtcatagatagcaatgaaaattcggctccctgtggcagcttctttcagccaccagacttacatagactcagtggtgcagagtccgtttcccaatactgagggataaagaaaattaagcctgcctctaggcacgtctcaaacttgggagactcagaatacaacagagtatgggatacagggaggaaagaagagatgcagaaataaattaaaaacaagatttgtttaaagaggaactgcaacttctttaattgggcagattgaaccaataaaagcacagttctctcccttcacctgttatcctttagtctcttcaactttcacattgcttcactcactctcttcctctccctttcacctgctcaccttacccaacttgaactgtgccctctgatctgacacaggatgacaatgacatcagtcattacctagcagccattttttctgataactagagttctgagtgatgatagttcatggtgagataatttccaagacctcgctagccattggtggtactactctccattaaagacaagggcatttgctgattgagaaatcaatcatacaagtgtccttggaggccaccaaggctttgcctgaactgttctcagcctatgatggtttctctttctaaacctgttcttctaggttcagctcaaacatcctctcctatagaaacctttccccatcctcccagtcagaactaatgatttcttttcacttcaactgtacttagtttataatttatatgactataatttaataactgagactcttctgatagtacaaacaggtgctatcataattacctctgggcaacaggcaaaaatcaagattgtccttagtaaaccaggattcataccaggtcatctgatgtttagtatagcactcacccgactctgccttacattgcttatttaaaatgtctgcctccccttctaggttttataaaagttcttggctcacagtaactcttagtataagtttctgaaataaacactttgttatcacttttgaattgatggcttacatttttgttttggcatttaacttcacatttgtgcattcatgtgtatgcatttcaactcatctgcaagcttatatccctcaaagtttgctgctgggctaagagcagccactcaaaaaataataataggccaggcgcagtggctcacgcctgtaatcccagcgctttgggaagctgaggctggtggatcacttgaggtcaggagttcgagaccagcctggccaacatgatgaaacctcatctctactaaaaatacataaattagccgggcgtggtggtgggagcccagctactcagggctcctcagctactcagctattcagctactcaggaggctgaggcaggagaattgcttgaacccaggaggcggaggtttcggtgagcgaagattgcgccactgcactccagcctgggcaagagtgagattccatctcaaataaataaataaataaataaaaaccaaaaaaaaaaataaatagtttttaaaaaatcttgacagcataccagcatacattcattgataaagtcgacaagaaagtattggagattaaagattgccaaaacctaagtgcttttcttggcatcattgtccttgacctcaaggagttctcagtgtaatcagagttgtgttaaggtcagtgagtgaaggaaatgggtactgcacctttgcaagatagtaggaagcaagccagagaagagctggcattccacaaaagagtctttatttgggacaaaaatcaatatgaccaaatcccatcctaatcaattctgtaaactaaaggaatttttaaaaaataatttagcaggaggaagagtttcaaaatcttgtagggaaaccctgatgtaactcctgattattcacccaaagtgaaaagtaactattagtgaatgggttttattttaaaacctttcatttttagaatcttatctcttctaggaaaagtgtagtacatacgaattttttgtatgcagagtgaatttttctccaggcttctctgacatcaatggggcaaggtcataactctataaaacagggagaagcactgagcattttcagaaaggactctatctgtcttgaccaaaagacaaaggactggtcattgcaggatccccagaaatacattttagtagtttccaagtgaattcttttgtaaatggagtttctctccattcataagttttagagcaaaaatgaagccttagtgggtctagatatctggctaacattaactccctgtgtgaccttaaactggtcgtccccaaagctttatgcttttatacaattaacttgatttacagcctctccttcttgcccataagaatgataataccacctgcattactcatcttttacgcttatgtgagacacctagccacctatcagaaggtattcaaatgcaaagcattaagtttttacactttaatgtgaagtggaagaaagtcttgattcaaatgcacaatctctacctttctactgattccacatttgctgtcttttactagtgcagttaagtcccaaattagaaacataagtcgccccaacatgtgacaaatgtcctttgttgccagagaaaggacagtggggctgtgtcctcagccttagcaaccagaagattctgcaagaccaggacattctcctgccagagcctgctttagtgtccagtcctgttctccaaagagatggaaaaaaccaagtggaaaagtttcagtttattcaatataaggctccacattcaaatggcaaaactgctctgttcaggtcatatttcaagcccaacctatgtcagtccttagtaaaagcttcaaagcaataccagtcctttcccagcctggtttaccttgattagacaaacacagacacccatgtctgagtaagcactgagaccatggatgagtgctaaggagattaggtgtttggatagacacagctagggtgtgtgcgtgtgtgtgtgtgtgtgtgtgtgtgtgtgtgtgtagagagagagagacagaggcaaagacagagacagtgctcattgggcagaggacagagtagctgagatagtatcatttgtttattcatttgctttttcataaaatacttagtaagcacctacttggtatgtgccaacactttaataggtactagaaagagcaaaacagacagaatcacagtcttcagagaatttacagcctatggggttaattaaaccaatgattatcatagcatgtaacaaacaaaagagaaccgagaatcagctgtatggaaatgcacacaggtggcagatataaatagcagcagatacacgaatcagtgcgggtccatcatataactcctagctttagtctctaaacttaggctcccactcaactcaactcctactctaactcaagatataccataccttggtttgctctttctctaagcatcgctgttctagtcttctaaggagcaggaatataaatctacatctatgtgaaactacagcacccccaagggaaaataaagaatccagtgctattctagtaattttagggcagtagtacagtacaatgcaaagtataggcttttgaactaaattggcctgggttcaaatatgagccctctcacattctattaggttgaaccatataaaaatggagatattcaatcatttttttacagtttcacgtagttcatctctgtattctagaggtaaatcattttaacctaagtttcatttccttctgttgttagtttttttaatggtgctaatacccctacctttcagggttgtaaatgaaaagatgttaaaaaaaaatacctgacatatagtgggtgttcaataaatgttagttttcccaaagatagtcagatgcatgaatcataataagaggtatttctggtcaacactaagcttaagaatccaagaaaagatatatcaaaatgagacatctttgggtttggatagtgggggaggctgtatatacacaggtatgtatgtaggggcagggagtaaatgggaaatctctggctcttctgcttaactttgccgtgagcttaaaactgctctaaaaaacaaaatctgaccaggcctggtggctcacacttgtaatcctagcactttggggggctgaagcagaaggatccctcgagcccaggagtttgacaccagcccgggcaacatagaaagaccctatctcattttaaaaaactaaaaaataaaaaataaaataaaaaacaaaatccatttttttaaacaaaaagaaaaatgagggaaaatgaggtgttctgcttgttttatttagactctgagcacagagttcccaagatacattctgctgtggtattcacactgatctccaattaaacccttctcagtgtgtcatgagctattcattccctatagtcactctgttagaatagaatcttggtcgtgtcccagaggcctctgttgatgtggcccaactgagctggccagtgagaaaacatacacataaatacccatgatctcagcgattctctcccctccccaggacattccttagcagaaccaatctctctcactcggctggagcctctctgttcacagataggcctggctgggcttaatttagcaaagggcaggccccctgcaaaagccaggggtaagtctggagcccctgtaatgccccaggacaccttgtgtggagacaggagcccagccctgccgaaggagctaaaggggatgttcagaatgtttgtttttctcagctatttaggaactggagctcacaggaaccaccctttacttccttaacttctcacataaatgttttctttgggcagcagctatagaactggaaactaagtaaaaccttactttggaatataaaaactatattaatttttctatagataaattgttgcataggaaacttgctaaatatttttaaattatctgtaacatctaacataatctgacatttatccccaaattcagctttcaattctggattgaaacatactttgatctgttctctaaaaaggacaaagccagtcactggtgttttgcaaagtctgggaccatttttcctacacagaatctcacacaataaacagacaagatattagaaactaagttctaatatctagcagtcactccttccctggaagcctggctgtgtcctgaagccaggtcctatgatcaggcaactcttctgaagctctgcttccactagagacagcacttaccctgtagactctacagatgtaccatccaggatggcaggcatgagccacatgtggctactgaacccttgagatgtgactagtccaaatcgaaatgtgctgtaaggatttcagacttagcacgcacaggagttcaaagactaactacaacaaaagaatgtgacatctcattaataattttaaaatgttgatttcatgttgaaatgataatgttttaaatgtattattaacattaatttcacatatttctttttactttttttaatgtggccatcagaaaaatttaaattacatgtatggcttatatttacgttggacagcactgttctataagatgttaggaaaaagatgtatttgctttaagtactttgcattaagacatagtctgacctgaatcacagttaatcctgtggtctcatagcatcttggagagttttgtggggtgctggcatccatcaaccaacaaaataccaaaatgactctaggtaattataagtgaagcaaaaccactgggcagggatgataacaggcactgtacttaacaggagtcagcgtatcacaatgctgctcggactatgttcagacactaaactctaagtgtcatgagggcagggactccctctatcttctcaccactgtagcattgctagcacaatgcccacacacagaagataatgatatatttatcaaacaaatggatgctgttcaaaataaaaatatagctctcttgaaaaacaattctccctgcaagaacttcctcttcttactgtttcttttctcaatttttttgcttcctacttccaccaacccctcttgcagagactgctccattccagtaaaaggtgaaggttcaactggagacctccaaagtcggctgggcctagggtttgggtaggcaattgctggaagagcacagagagggaaagatttcaggcagtggtgataagaaaaggcccacctgggtcaggtgtggtggctcacgcctgtaatcccagcactttgggaggccgaggtgggcggatcacgaggtcaggagttcgagaccagcttggtcaacatggtgaaaccccgtctctactaaagatacaaaaaaattagccaggtgtggtggtgtgtgcctgtaatcccagctacttgggaggctgaggcaggaggatcgcttgaacccaggaggcagaggttgtagtgagccgagattgcaccactgcactccagcctgggcaacagggacatactctgtctcaaacaaacaaacaaacaaacaaacaaacaaaaaaaccagaagaaagcactggcagtctcttaccgccatatcaatccatctacacatctcgggttacattctctgtctttccacttataaccatagatcaactatccatgctcctatctaaagccaaaccttccacttatgtattaattaagtcctattccccctacctctcaaaggcaacacctagaaggtctcccctgcttctctttatcaatatttcactttctaatggaaaattctgttggcatacgaacatgctattattcatttatctttctagaaatcccctatggacctcatacccttatcaggtatgccccattcctttgctctcctttgaaacaaaactcaaagtaattattcatcctcattgactccaattcttctcctcacattgtttcttaaacccactgcaagcaggcttttgtcttcaccactccaccagaattactttaatcaagatcactaatgacatccatgttgttaaatccaaaggtcaattcttttttgagacagagtcttgctctgttgcccaggctggagtgcagtggtgcaatctcggctcactgcaacctccgcctcccgggttcaagtgattctcttgcctcagcctcctgagtagctgggattacaggcatgcgccaccatgtccagctaatttttgtattttcagtagagaccgggtttcaccatgttggtcaggctggtctcaaactcctgacctcaagtgattggcccaccttggcctcccaaagtgctgggattacaggcgtgagccaccacgtctggcgggccaaaggtcaattcttaatcatcgtattactcaagctctcagcaggatttcaaaaggtggatcctgtcctcttcactacacacattcttcatttggcttccgggactccagactttttctcctacttcactggtttgtaccttctctatcttccttttctgattcttcctcttttctccaaattactaatgttggagctatacaggaccagtctctggtccttttctcttccacctggaaaggtctaactccaactcctttggtcatctcctatggtttcatggctttaaatatttaaatttaatatttaatgatctatttgctgataactcccaaatttatgtctctagccctactctatttcctgaactttagacttacgtattcaactgcttacttaatactgccacataaaatgtctagcaaatagcttacacaccaaatttccaaaactgaacccctactctccaccttcaaatctgctccatccgtagccttccctatctcagttatggcaactccatccttccagttgcttactccaaaaaccctggaattttccttgattcctttatttctctcccattctgtatccaatccattggcaaaatccttttagatttgctaccttcaccacttgttcccacatgcatcactattacctaagtctgatcactatcagcccctacatacattactgcagtgtcttcctaagagtcctcctggtgtctacttttgttctacagcctatttgcaatactgtaaccagatttatcatttcaacaagtcagacaggactggcatttgttagacccctcctctgctcaaaacccttcaataggttcccatgtcactctgagtaaaagctgaagtctttaaaatcatctacagggacttactacacaagccccataccctctggggcctcatcttccagcatgcttaatcttgattatgctgcatcagccacagtggctttcctgatgtttctctgcctggaatattcttcccccagttctctgtttggccaacttcgtcatctccttcaagttgctatttgaaaattattttctatggcatagccactttgaaaaatagttagacagtatctattcagaaaataggcagaaataccgactgggcatccctaatctaaaaattcaaaatccagcatgttccaaaatccaaaactttttgaggaccaacatgatacctcaggtggaaagctccatacctgacctcatgaaaggttgcagcaaaaatgcaggcacaacacccagtttattcagcatccccaagagaaaaacataattaccttcaggctatgtgtacaaggtgtatatgaaacataaataaatttcatgtttagacttgggtcccatccccaagatatctcattatgtatatgcaaatatttcaaaatctgaacacatctgaaaatcttctggttcaagcatttcagataagagatatttaatctatatatacttattatataacctaacagttccactactgggcatttacccaaaagaaataaaacaaagacttgttacatgaatattcatagcagcttaatccataatagcctgttactgaacacaactcatacattcatcaacaaatgaatgaataaacaaattgtattatattcatacaatggaatactactcagcaataaaaatgaatgtactactgatacaaatagcatggatgaaactcaaaatcattattctaagagccagatactatagtctgtattttatgattcactttcaatgaaattctacaatagacagaactatctatcaacagaaagcagatcagtggttttctgcagccagaggtatgaaaggtttgaaacacgtggcaccagtaggacatatggaaacttttttggtgtgatggaagtatttttttatcttgattgtgtggtgtttgttatacagtggtatacatttgttaaaatttatctaactgcatacttaataaagtttatttaaacaaaacatgaaaggaaaaactaaaatgacatagcaagtggcaatgcaaactgccaagtgcaaagaatgagtaaagagcttggttggcatggagactaccagtctaggatgcttttattgcctcaggtcagcttggaaggccataaatgctgtgaaggtaaacctagaaacaaatcttcctgcactggtaactgtcatgtttatttgcttccctttccatcccatcctttcaaaaaaaaaaagtaaaaggtagtgtggtccacaaactaccgtgtggctccccatgatccccgcctcttggtgtttgtgcccttgtgtaactccttctctttgggtatgagcaggccctgcgacttatttctaaccaatagaatatggcaaaggtgaaggaatgtcactcctgtgattatattaaatttcaaggctctcttgcttgcagatttgctctagagcctctccttgctgacttgaagtggccatatggggaaagctcacatggcaaggaacactaggtgacttcaaggaaccctggacagcctctagccaacctctggcaagaagtcaaggccctcagtcctactgctacaaagaaatggattctgttgacagcccaagtgagctctgagtcagattcctcagtcaagcctctagaggagaatgcagcctggccaataccttggctgtagcctagggagaccctaagcagacaacccagctaagcggtgcctggattcctgacccacacacactgtgagataataaatgtgttggggggtgaaggagggatgggggtaggggtggctgtgcatttgggtatggaagggtgttttaaatcgctttctaaacacggcctctcctggccactccttaatactgcaacctgctctccactcctgtaattttttttcaacatttgttttaggttcagggggtacatgtgcaggtttgttacatgggtaacttgcatgttgcggaggtttggtgtatgaatgaacccatcacgcaggtagtaagtatagtacccaatagttagcttttcaaccctcgccccccttctaccttccactggggtaggccccagtgcttattgttcccatctttgtgtccatgtctcaaagttttgctctcacttataagtgagaacatgcagtatttggttttctgtgcctgtgttaattagcttaggataatggcctccagctgcatctcttttgctgcagaagacatgatttcattcttttaatggatgcatagtattccgtgctttatatgtaccgtatttttcctccccagtctactgttgatgtgtatctaggttgattccatgcctttgctattgtggatagtgctgcagtgaacatgtaagtgcatgtgtctttttggtagaacaatttattttcctttgggtatatatccagtaatgggattgctgggtcaaatggtagttctcttttaaattctttgagaaatcaccaaactgctttccgcagtgactgaactaatttacattctcaccaacagcgtataagcacttttctctacaaccttgccaacaccttattttttgtttttcacagtaggcattctgactggtgtgcaatggtgtctcattgtggttttgacttgcatttctctaatgatcagtgatattgagcatgagaattttttcaaatatttgttggccccatgtatgtcttccgttcatgtcctttgcccattttttagttgggacaaggtctcgatctgttgcccaggagtgcagtctgatcactggagttcagtgatgcaaacacagctcactgcagccttgacctcctaggctctagcaatccttccaccactgcctcccaaagtgctggagtttcagatttgagccaccacacctttgctcatttttgaagtggggcaagacccccacttcgtaggactattacttgattgagattaaatatgtgtaaaatgcataacatggtgcctggcttatagtaaacactaaatggatttcttcttccataggatttaaatagggagcaattttttttctatcaagagctgatcagaaataaatgggaagcatttaaatgctctccttcccctgtcccaagaggactttcactttccaacattctacatactttatttataatatttattgtttattttctgtctactcatgacagactataagttctatgaggatgggaatgcctgtatgtgcttattatatgacctaacagttccactactgggtatttacccgaaagaaataaaacaaagacttatacatgaatatattgatatatactccagtcacctccaatagaatctagaacacagtaggggcttagtacatatttttaaatgaatgaagactaatgtttagtttaaactaggattgacctattcttatcttcggcagagacagagaataactaattaccacttgtcacatattgagacttcagtacctaaaaggcattattaggtcacctgtaagtctgttttcccccaaagtaaaaatcccaattccattgcccttttcacataagcctcattttctaacctttttagtttggtttaacgaatttcctatttcctctgaattctggagttccaaaccagactcagcacaagcctaacagggcaacctatacagataaggacagcccaggcacattgcacacggcaagttgcacctgttttaagagtaaaaatgaggtcaatgccaccttgtactgcaggtacctcaatgagacaatgccaccccttcctgccacaatcttggcaaaagtcactacgaaagtaaatatcattttactagagtcctttctttctctccagtgaataacacaatgtagttattcactggaaaacatcatttgcatttgaaagagttactaactaaattctaaagaatgtaccaaagccttgcttaactgtagaatgaggccacacggctgctgggataccaggtactctccctgagcctattgatggcaaatttcatcctgtgaaaaatgggaacaagacacccacttcataggactattatatggttgaaattaaatatgtgtaaaatgcataacatggtgcctggcacacagtaaacacaaaacagatttcttcctctatagcatttaaatgggaagtatttagcgtttacttgccatgtgcatgagtgaatttgggaaaagtggggggaggatatggggcaaagaaggacagaaagggcctaagagtaggaagaatttaataccagaagatgggacaagacctgggtctagaaacctcttctgcagataaagtagctgcaaattatagggaaggagtcctcaggctgctttccttataaccatttattttcctgcaccttatatcaagaacgttaggcactggttaagaccctgtccccttgcagcagtagagaaaacaggaggaaggagacgggaggtagaaatttggaagctagcagttgaaggccaactcagaaagcgtcaggtggaattccattcctaattgacatcaccatcctctaactgcagcaattctctccagcccttttatgtgctccctacagaaccaagcttccacacagctgaaggaacctgtctgctctcaccccagcttcacagaagatggcagggactggttattactaacctgcctcctagtcttctgaggctccaaatggttttgtcagcaagctgagcttccccacaatcccacagactagaaggggttggaaagaacaagccttagaacaatactgctccccacctctaagggatctgctcctctgagtcccagaagttcaccgccttcatttgatttctgctacaggaagactctgggaatccagctctggacccagcacttcctgatttttgaagtagagagttgacaaccctgttgtcatcaatacaactgtgctaggtgggtgggaaaggaaaatatcttgggctcccaaaatcactaagctaaaaggaaaactcaggatcatggtggatggaagtcaggactagattgcagctccgactcggatggacagagaagcatgtggaggctcatatcatgaatttttgctccagaacgactggaggaataaattacaaaacctgagaggacccacaggccccctgaaggaagcagatggctcctgcaggacccaggagacacaccaaatactgtgttagtatttacttatagaaatgcaaaatggtctggaaagtctcagccatagaatcaaacaagtagaagaaagaaattcagagctcgaacacaaagtcttcaatttgacccaatccaaccaagacaaagaaaaacaaataagaaaatatgaacaaagcctccaaaaactctgggattatgttaaatgaccaaacctaagaataattggcattgctgaggaagaagagaaatctaaaagtttgaaaaacatatttgggggaataattgaggaaaatttccccaaccttgctagagacctaaacaaatacaagaagcacaaagaacacctgggaaatttattgcaaagagatcgtcacctaggcacattgtcatcaggttatctaaagttaagacaaaagaaagaatcttaagagctgtgagacaaaagaacccagtaacctatgaaggaaaacctgtcagattaacagcagatttctcagcaggaatcctacaagccagaagggattgggcccctatcttcagcatcctaaaacaaaacaattattagccgagaattttgtatccagtgaaactaagcttcatatacgaagagaagatacagtatttttcagacaaacaaatgctgagagaatttgccactaccatgccagcgctacaagaattgctaaaagaagcttcaaatcttgaaacaaaacctggaaacacatcaaaacagaacctctttaaaatataaatctcacaggacctataaaacaaaaatacaattcaaaaaaacaaaaacaaaacccaaaaaaccaaggtatacaggcaacaaaaagcacaatgaacggaatggtacctcacatcccaatactaacattgaatgtaaatggccgaaatgcgccacttaaaagatacagaattgcagaatggataagaattaaccgaccaactatctgctgcctttaagagactcacctaacacataagagacttatctgacacataaggactcacataaacttaaggtaaaggggtggaaaaaagacatttcatgcaaatggacaccaaaagcaaaagcaagcagaagtaactattgtttttttgttttttttggtttttttgagatggagtttcactcttgtagtccaggctggagtgcaatggcgcgatcttggcacactgcaacctccgcctcccaggttcaagcaattctcctgtgtcagcttcccaagtagctggaactacaggtgtgcaccaccatgcccagctaatttttgtatttttagtacagataggtttagtacaggcaggggtgatccgcctgccttggcctcccaaagtgctaggattacaggcataagccaccgtgcctggcccagcagtagttattcttatatcagacaaaacaaactttaaagaaattgcagttaaaaaagacaaagagcggcattatataatgataaaaggccttgtccaacaggaaaatatcacaatcctaaacatatatgcacctaacactggagctcccaaatttataaaaccatcactaatagacctaagaaatgagatagacagtaacacaataatagtgggggacttcaatatgtcactgacagcactagacaggccaatgagacagaaagtcaacaaagaaacaatggatttaaactataccctggaacacatggacttaacacatatatacagaacattccatccaacaactgcagaatatacattctattcaacagtgcatggaactttctccaagatagaccacatggtaggccacaaaacaagccgcaataaatttaagaaaattgaaattttatcaagcactctctcagaccacagtggaataaaactggaaatcaactccaaaaggagctttcaaaaccatgcaaatacatggaaattaacctgctcctgaatgatcatgaaatcgagatggaaattaaaaaaatcttcaaattgaacaaaaatagtgatacaacctatcaaaacttctggaatacagcaaagtcagtgctaaaagggaagttcatattcctaaacacctacatcaaaaagtctaaaagagcacaaacagacaatcaaaggtcacacttcaaggaactagagaaacaagaacaaaccaaacccaaaccagcagaagaaaggaaataaccaagatcagagcagaactaaatgaaactgaaacaaacaaacaaaaaatacaaaagataaatgaaatgaaaacctggttctttgaaaagataaataaagctgccgggcgtggtggctcacgtctgtaatcccagcactttgggaggccaaggtgggcggatcacaaggtcaggagatcaagaccattctggctaacatggtgaagccccgtctctactaaaaatacaaaaaaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttataggtgggaattgaacaatgagaacacatggacacaggaaggggaacatcacactctagggactgttgtggggtggggggaggggggagggatagcattaggagatatacctaatgctaaatgacgagataatgggtgcagcacaccagcatggcacatgtatacatatgtagctaacctgcacgttgtgcacatgtaccctaaaacttaaagtataataataataaaataaaataaataaaaaataaaaaataaaaataaaaatacaaaaaattagccggacgccatggtgggcacctgtagtcccagctactcgggaggctgaggcaggagaatggcatgaacccgggaggcggagcttgtagtgagccgagatcgcaccactgcactccagcctaggcgacagagcaagactccatctcaaaaaaaaaaaaaaaaaaaaacctagaagagatggataaattcctggaaagatacaaccctcctagcttaaatcaggaagaattagatactctgaacagaccaataacaagcaacaagattgaaatgctaatttaaacattaccaacaaaaaaagtccaggaccggatggattcacagcagaatgtaaccaggcattcaaagaattggtaccaatcctattgacactatttcataggattgagaaagagggaaccctccctaaatcattctacgaagccagcatcaccctaataccaaaaccagaaaaggacataaccaaaaaagaaaactgcagaccaatatccttgatgaacatcgatactaaaatccttaacaaaatactagctaaccgaatccaacaacatatcaaaaatataatccaccatgatcaagtgggtttcataccagggatgcagggaggtttaacatacgcaagtcaataaatgtggtacaccacataaacaaaattaaaaacaaaaatcaccatgatcatctcaatagatgcagaaaaagcatttgacaaaatccagcatccccttatgattaaaactctcagcaaaatcagcatacaagggacatatctcaatgtaataaaagccatctatgacaaacccacagccaacgtaataatgactgggggaaaagttaaaagcatttcctctgagaactgaaacaagacaaggatgcccactcacaccactcctcttcaacatagttctggaagtcctagccagagcaagacaagagaaagaaataaaggggatccaaattgttatagaggaagtcaaactgtcactatttgctgatgatattattgtttacttagaaaatcctagagtcctccagaaagctcctagaactgataaaacaattcagcaaaatttctggatacaaaattaatgcatgcgaatcagtagctcttctatacaccaacagcgaccaagctgagaatcaaatcaagaactcaaccccttttacaacagctgcaaaaaataaaataaaataaaatacttaggaatatacctaaccaaggaggtgaaagacctctacaaggaaaactacaaaacactgctgaaggaaatcatagacgacacaaatgaatggaaacacatcccatgctcatggatgggtagaatcaatattgtgaaaatgaccatactgccaaaagcaatctacaaatttaacacaattcccatcaaaataccgccatcattctttacagaattagaaaaaacaattctaaaactcatatggaaccaaaaaggagcccgcatagccaaagcaagactaagcaaaaagaataaatctataggcatcacattacctgatttcaaactatactataaggccatagtcaccaaaacagcatgatactggcataaaaataggcacagagaccaatggaacagaatagataacccataaataaactcaaatacttacagccaactgatcttcgacaaagcaaacaaaaacataaagtggggaaaggacacccttttcaacaaatggtgctgggataattggctagccacacgtaagagaactaaactggatcctcatctctcaccttacacagaaatcagctcaagatggattaaggatttaaatctaagttctgaaactataaaaattctagaaggtatcatcgaaaaaacccttatagacattggcttaggcaaggatttcacgaccaagaacccaaaagcaaatgcaataaaaacaaagacaaacagctgggacttaattaaactaaagagcttttgcacggcaaaaggaacagtcagcagagtaaacagacaacccacagagtgggagaaaatcttcacagtctgtacatctgacaaaggactaacatccagaatctacaacaaactcaaacaaatcagcaagaaaaaaacaaacaatcccatcataaagtgggctaaggatatgaatagacagttctcaaaagaagatatacaaatggccaacaaacatatgaaaaaaggctcaacatcgctaataatcagggaaatgcaaatcaaaaccacaatgtgataccaccttactcctgcaagaatggccataatcaaaaaaataaaaaaatagtagatatggatgtggatgcagtgaacagggaacacttctacactgcttgtgggaatgtaaactagtacagccactatggaaaacaatgtggagattccttaaaaaactaaaagtagaactaccatttgatccagcaatcccactacagggtatctacctagaggaaaagaagtcattatacaaaaaagatacttgaacacgcatacgtatagcagcacagttcacaactgcaaaaacgtggaaccaacccaagtgcccaccaatcaatgagtggataaagaaactgtggtgtgtatatacacacatatatatatatatatgatggatatatatatatatatatatgatagaatactactcagccaataaaaggaataaattaacgcattcacaatgatctggatgagattggagactatcattctaagtgaagtaaggcaggaaaggaaaaccaaacattgtatgttctcactcataagtgggagctaagctataaggatacaaaggcataagaatgacacagtggactttggggactcaaggggaaagggggggaagtgggtgagggataaaagatcacaaatagggtgcagtatatactgcttgggtgatgggtgcaccaaaatctcacaaatcaccactaaagaaattactcatgtaaccaaacaccatctattccccaataacctatggaaatgaaaatacaaaaaataaaaggaaaactcaagctggaaactgtttagggcaaacctgcctcccattctattcaaagttatctctctgctcactgagataaatgcatatctgattgcctcctttggaaaggctaattagaaactcaaaagaatgcaaccttttgtctctcttctgtgacctagaagccgcctcccccactgcaagttttcctgcctttgcttcaagttgtcccgcctttccagacctaaccaatgtacttcttacatacattgattgatgtctcatgtctccctagaatgtacaaaaccaagctgtgccccaaacaccttggtcacatgtcataaagacttcctgaggctatgccaggggcacgtgtcctcaaccttggcaaaataaactttctaaatttactgagacctgtctcaaattttcggagttcacagtgggcaagactagatttacttttgtgttgagcagatactgagcttgactgatgagaatctggagtgtgaggtctgacggagtaactctgagagaggaagctacctgtgtggtctcagggagaagatctgagacttaccaagaaaaagtgacctgaaagaactggctgacttcaggcccttgaccagtgcctagaccctctttctgcagctccagatcatagccatcatgctggcagcctccctgccgctcatccaggcaccttaaagaagggcttcctcttcccaagcctctgggtgggctttctaaagccctgtgtgcatgaagaggtggcttgtagccctttgcagcagcagggcttacatgaggctgggatatgaaaagctggcattacaatgcagcttgtgccttgcattcactccccacttcatcaagccaagtttctaaataacagggatagtaactgcccactgtggcccaatgtcacttctaaagttgcttggcaaaaagccacatgactattacttagctctccacagaacggcatgtaccaagtcggatcactgctgtcggtgtgtgggtggattagctgctattgaacatgatagggcgggcccctttccagtttgcaccagccccgctctgtgcctactccatgtatcatagagcctcctctctctgtgcagttgaacttgatcagatgagatggcaaaagccagagcagggagcaaggcaaaagagaaaaatatgttcacggtgacttttgaaaacatatggatgaaactcctgaggaggctgaggaactaaaccttttcttttggcagtaggcacagagtgcagattcatctctctgtgaattactctagctcctgctgtgtgagttctattttagcccagtaatgcaaaaagaaagaaaaactaagttctgacaagcacttacatttcttgaatttttgttgaaggtcccagaggtcattgtaagcagcctgaacaggtagttagggctcctggattctagtctcagcttggctactaatttaccgtgtgacgttaggcaaattactattctgagctttagtcatcttatctttaaaatgaagggtttattctttagaggaagctgagtgaatggcatacgggaacactctgtactatttttataactttgctataagtctaaaattatttttaaataaatggttttcttaaaaagtgaaaggattatgtagattatcttcaagatcctctctacctctgaataatgattttatgttcttacttatcttccttcaggtgaaagtaagtctctttccagctatccaaacatataacagagtggaatttttcctcactccttctgccccaggcaagatgttgatcagccccaacacaaacctgttttctgctttaaacatatcctatacctagggcaaaatttaaattatctaaaacacatttaaaaacaccccatccatacccactttgttctttcaaacaagtaaattcacccagcagggaaaagctgttgctggcagtccatgcctacagaatctcagccttgccctagcaacgaggctaattataactccggctacctggtaaccgcactagatttccctgcattggctggcagttctaaagccatctcagctctgcctgccacctcccatcctgagaagctgtcagagaagctgagaaactatgagtctcttttaagcaactatctaagctgtggtgagaacacccatgtatcatagagcttcctttctctgcgcccagagaaaggctgcccagaatcacaggacttcagaactgggagggatgtgtgcgtcaatcctggtccagcccactcatttaaacacaaagaaccagaagcccagaaaaagtgacttgccttagcctggccttcctcttgattcctttccctcaattctcccgtcctgatcaatcatcaagtcctacaaatattttacctcttaaatattttaaagatgagttgcctcccctctattcctactgccacagccctcattcgggccttcatcttctttggcttggcaagtctgttctcactcacttcctgccttgactctcttgaatccacctttcccatgcatcagagggatctagcaggttccctgcagcttaaagcccatcagtggtgccttgtcttcttcaggataaagtctacactctttaaaatggcacaaaagactgtgtccgtcatatcagtctcattcttcgcctagtacttaaatccaccaacaccaaaccacttctaattctgtgcaagcaccctatggtttcttgcctcaaggcttttgcttgtgacaaaaactctgtccttccacttcatcatccattgactgattagtgcttattcccctttgaagacgaagttcaggggtcatcacgaataatcctttgcagattttctttccatccactctattcatttgggatagaagtgccccctttgagttgccttacactttgtacacagctctgttactgccttttactatactctagcacctgtggtttactcatctttgaagtcccaacttctagtacttggaacatagcaggtacctaattaatgtttattaatgaatgaatggataagtccaaagctttccatgatttctcccctgcagcctcatcttaccaccaccacaagccctccaaaccacatgatctagccatactgaatgattccagtgtgccaagtgcacattgcttttgtacacctctgcttttgtatattgtttcttctgtttgaaatgccttttcccaccaggcgcggtggctcacacgtataatcccagcactttgggaggccgaggtgggtggattacctgaggtaaggagtttgagaccaccctggccagcatggcgaaaccccatctctactaaaaatacaaaaattagccgggcatggtgacacacgcctgtaatcccagctacttgggaggctaaggcaggagaatcgcttgagcccaggagacggaggttgcagtgagccgagatcatgccactgcactccagcctggctgacagagcaagactctgtctcaaagaaaaaaaaaaagaatttctggattttccaggcatggtggctcatgcctgtaatctcagcactttgggaggccgaagtgggtggatcacgaggtcaggagattgagaccagcctggctaacgtggtgaaaacccgtctctactaaaaatatgaaaaattagcgtatgtttcacagcatctgtaatcccagctactcaggaggctggggcaggagaatcgcttgaacctgggaggtggagattgcagcaagccaagatggcgccactgcactccagcctgggccacaaagtgagactccatctcaaaaaaaaaaaaaaaagaagaaaaaagaaatgccttttcccatttcttgttatgttactaccttttaggattcaatgcaaacttcaaacacttggcaaggcctttcctggtggattttattgcactatagcaaaatctgtccatacctctatggtagcccttattataccatttttatttatttgttgatgtcttctccaccagaatctagcacagtagctggcatatagtagataatcaatagacgtttgactgaatataccaatgcatatgcgcaaatatgagcaaaaaaatgactaaaatgatattgcaaacaagggaaacatttgagacagaaatttagaatgtctatttttttcaagtgtaacatgctacttctatcagtgcataaacctgaatgtacatacactatagaaagaagtggccttgtaataagttcatgcagaagtataaattatgtagacattgttagggggataactgaaagtggattagaattaaattagggcccagaatttagtctgggatttgttttccagtggttgaaagaaaaattcctaagtattcaaagggaagaagcatttctcaacaggcaagtattatgaattctaattaaaagctctgaaaaaatgagataagttgtgttaaggaaaagcagaaaacagagttgcctttggttaagagttccactatttttataagcaactgacttttttggggaaagttgctttaagcatttttttttctgtgtgtatgtgtgagatggggtctcactctgtcacccaggctagaatgcaggagcacaatcatggctcactgcagcctcaaccttctgggctcaagcaatcctcccacctcagcctcccaagtagctggtaccacagccacacaccactatgtcagctaattaaaaaaaaaaaaatttacagagatgcagtcttgctatgtttcccaggctggtctcaaactcctgggctcaagtgatcctcccaccttggccttgcgaagtgctgggattactgacatgcgccaacatgccaggcctaaacattttgtgtgtgtgtgttaaaatatacatataataaaatttgccattttaactattttaaagtatatagttctatggcattaagtacattcacatagttgttcaaatatcactatccatctccagaactttttcccaaatgaaactgtagccactaactccccattccctcctccccacaacccctggcaaccatagttccactttctgtcttcattatttgactactctaggtacttcatttaagtgaaataataaatatttgtcctttagggactgactttacttagcatgacatctttaaggttcactcatgttacagcacatgtcagagtttcatacctttctaaggctaaataatatccagtgtctatatagcccacattttgtttatccactcatttgtcaatgaacacttgagttgcttccacctgttggctactgtaaacaatgctcctatgaacacagaaatacaaatatctatttgagttcctgttttcatttattttgtgttatacccagagtagaattgctggattatacggtaagtctatgtttaattttttgagaaactccatactggttttcacagcacctgcaccatttcacattctttctagcaatgtgcaagggttccaatttctccacatctttactagtatttgttattttctgggttgtttgatttttagtataatagccatcctaatgagtgtgaagtttgaaaaaatatttaaccaaaatcataaatattggttacaaatatttaatggatggattccctctatttctgccaactttcattccctgaaagaagaaataggtaagcatgacctcacgaacctcagaaggctgagaatggggaattggcacacacagtgtgcgtagacacagacacacatggaccatgttcatactaggcttccagagaaccatttaaaaatagtttggctaatgtaatcttgtctgtctcttatgttcctcctttcccatcatacacatttcttaaagttcgtgtaagtaaaacataggagaaaaaaacatagccactaattaaataaggcatccaagtgtaaaagaagagcaaactctgctacatataagaagacaagcattaattctggcaacagcagccacacagccactttagacaataacctgagcaggtgcatgctttctagtatgtgtctccagctatgcaggatagaaatcacaatcctttctatttatctaacgtctaatacactaaaacatgtttacccatgggggagaagagcacgacaggaattgatgactctaatttaggaaactaaggttcacagaagttaagtgacttggccaagatcatgtagctagaaaaggcaggttaagaattcaggtttccttagagttcaaaacttttatcacaacatttttgataaccccccaagatactcatccttctctaatagccttcctttggttcaagtccagcttcctaaatcctaccgcctgatggagttcctgagcttccttgtaagtctgcaggtatattgttcctcatcatgttgcccaaagcctaaagaaatcaggctaggaccaaagaaaatcagtcaatgagccaaaaagaaatttaatcaacccagcctttcttatttattttctttgaatgaacatttgtatctgagaatgccaaggtaaatttgatgcaatagggacacttggattatattatgttatttacacacaagcaaacaaaaattgagaattgagacaaataggacaaatggtcccaagtccactattgaggaaaaagaaactgatttggaataaaaaatagtccagcatgaatgtgtcagtaattaagacttatctggataagtttgccgtctctcaatttgtcacaataatggcaaatatttattgagagcttactatgtgataggcattatgctgagttcagctaattgactcatttcatcctcctctagaccctataagataggtgttattactgcccttgctttagctcagagaaattatggtatttttcccaacacaaatagtaagtagaaaaatcaagatttcaccccaggtctcgccaatttatagctcttagccgttatgcccagcaataacagaatagtaaaaacaaggacaatttggtaggcaagtaaaatcagtaggctgtttaccatagctatagaagtatgctatgcataaacctcaaagattgcgcaggaaaagtatcatccaatctcaaagatgagaaaaccaaagaagtttcaatctcagagaagtcaggcagcttaagggtcataaaacaacgcaacacaactctctcaactcatatctaagggctaagtccactttaaccttccaatatcattacatcatatttaaacattgactctatctggtcaaggacgacaacattttatttctcctgacccttttgctatcagatctggccttgtcagtttttcaatttcattcttagaatggaaacttaattcacacaagttgaacaagtagtcatcagggggcaaaacccagtggatgatggttttgtgtgctgtttggagactgggtgtttaccacacagcagtggatttcataaattccagggtcagacaagattccagtagcgacacacttgactaatatgagaaaatgcaggattaggcaatcaacaatgaggaagtcagccaagttgccacccaaaaattacttaccacagcagctgcagtccagaaatgctaacaagccagtctccctaggagtgggccatactcagctgtggaccactcacaacattttctcactttattttgcttcagagtcagtgtactgcaatgatttctcctttgcttgctttatatgtttaaaattgtcttccctaaaagctgaacttaaaattaatgtttgctaccaaaagggggtagcagtgcctagtcatgtaggcatatgtcccactctgtcggtacagagggtaagcagcctcttcctttttaaaaaatttattacgatgatttacaaaaattgaagcttacaggataaacactcaacaaaaaagtagccagtctcaagaaaccaatttttatgtatgaattaatattattttattaatccatggccaggatgattcttaagattatttcttaattctctgaacagcttaaaagagagaaactccttcttttttatttacttgctttgaggttgatactcttaggtttttaacataactctctagctttgacaactcctcttataatttaaaatccttatagcttccatttacaagtaaggattatatctattttagtctcctcaatcagctacctaggagaagacttgccacttggaaagagaaagatagcacccactctccagttctcttctcccaaagttgcccgtatttcccttccctgaagccaatcaaatactttattgtttctcgctaagagtaatttttcactcttaagtacaaacagctcaacaaaaattcccggtagcataaatatgcacatcaataaaataattactactcacaatagactttccattacatatgtttcacaagcattggttttcttaaaaagaaccacgcatacagcactcaaattattgcagattctaactcagtagagtttgatttaatgtttttacaatattttttttaaagaagtgtccttccaacgctaaggaaaaaaatcagaatcaagaaaattctgtttcttagcaacagaaaaatcaaacttctgttactaagtttggtaacagaacagtactctaaattatcctctgaaccacctgatttaccatgtgatgctgggcacattgctgctaattaatcttcctaatctcgtgggatcacaatatgaataacaagaatgaacatcagacacatctgtgggaattatgagggggagattataaagagtcaaaccttgtccccatatttaaattttataataactataactactagtagaaatataactactaccctctcatatatatgtgatgttattaagtttataaagtgttttgatatgtttcttatttcatcttcatggctgctatttattcatagaaaaataattctcagtatctgtagcattattgttaatgtcaatcctatagaggctggaacaggctcagagaggctaagtaacttgcctaactaagtctcctggttgacaataggtcttaatgcagtgttttccgaatccctcgttcttacatcaaaacagaactgtggctgggtgtggtggctcatgcctgtaatcccagcaatttaggaggccaaggtgggaagatcacttgagcccaggaatttgagaccagcctgggcaacatagtgagtgagacctcaatctctgccaaaaaaaaaaaaaaaaaaatacatacacacacacacacacacacacacacacacacagacacacacatatatatataaataattagccaggtgtggtggcacacctgtggtcccagctacttgggaggctggggtgggaggatcatttgagcccaggaggtcaaggctgcagtgagtcgtgacggtgccactgcactctagcctgggtgacagagcgagaccctgtctcaaaaaataaaataaaccagaacggctctagttcctatcaatcactcatcatgacatagtgtggtaaactaatttcaactctgaatgattgataatggctttatgtgttctgtttcccaagtaataagaacattttagcacaagcctttagcgcttttcaaataatcatagccaaatgagaaaattaatatgacaggcagattgaacaaacatttggtgagaaggaagaggaggggatacagtagtttgagatccctcaaatcatatgatgcagtagctgcctgacaactctgctaacacgtaagactagatagagacagggccatatctacttcctgtatgggacccatggcaatactagagtctagcaaaagggttgtcctctctgcatgtgacaataggctgtgttccactccccccacatacaccttgtgcagctcctataatctcatttatcacacttctccaggtgagaaatggtgccttctcacaccccacccaaagttgtttcctaaagatctttcgctagggcggagcagagagtgagatcaaatgattcagacagccatctgattcagctttaaaaaaaaaaaatcctggtgggggcgcagtggctcacgcctgtaatcccagtactttgggaggctgaggcgggtggatcgcctgaggtcaggagtttgagaccagcctggccaacatggtaaaaccccgcctctattaaaaatacaaaaattagccaggtgtggtagcaggcgtctgtagtcccagctactccggagaatcgcttgaacccaggaggcggaggttgcagtgagctgagatcgtgccactgcactctagcctgggcgacagagtgagactctgtctcagaacaacaacaacaacaacaaaatcctttccctcaaattacctaagaaattgtcctttccttctttgccctgaagacagttaatggggaaagttcctccctctgcacagtgaataaatccatccactattcctaccctaaccctaaggcaaaacctcccactcatcctctgtctctcgccatctctctgttaccaaccctcacttggcaatatccttcttgacacgtggcagctccaatgaggcacactcattacatagccacgtaaaagataaaaggtgaatctggaccaacttctggaaaatttggacttaaaacatggaaatgcaggagagacaggaaatagagttaaatcccccagatttagctatacacattaattgaattaactaaataatcatttgggtctcatagacaccagctatttccctgatccaagatgttatctagcagcctgtatcgcttcccagtcatccatcctcttgacaggacagagcacacatagaaaatggtatttgtatagtcctctggggtaaacagttggagagttagaatctctgataaggtcagaggcaaccagtccccggtcacttgggccacttcaggtcctgcttgtccagacacagagagggctgaggaaaccaatattgtggtgaccagctacgaggcttaatcctcataacccatagcccaatgtcctcttatcaaggtgctgtcctatctcacccacagctcagccaatccagtaggtcttccttccccaccctgatcactgacccatcaatcaagatagccctcccatccaaggaagaggccatttcccctcccactccacccaggccaactgctatcccacaggttactctcttcttcattttaaggcaagctattccaaagactaaaaatgcctaagattctgtcttaaaagcttatctgcatagtcatcttcaaaagcaaacatgaatttctcaaggaacggaaacacccttagcccctgcccttttctccatagcatcattctctgccccaccaagccggaactaggagggcactttctctaggagaggtatgacctggagatgatctgcttcagagccacctcagggatcttgcttaaaaatgcatattttcccaggcaaagtggctcatgcctataataccaacaacagtggaggctgaggtgggaggatctaaaggccaggagtttgagaccagcctggacaacatagtgccacccctttggtacgaattttttttttttttttttttgagacagactcttgctctgtcacctaggctggagtgtagcggcgcaatcccgtctcaccgcaacctccgcctcctgggttcaagcaattctcctgcctcagcctcccaagtagcttggactacaggcatatgccaccacacccgctaatttttgtactttttaagtagagatggagtttcaccatgttggccaggctggtctcgaactcctgacctcaagccttctgtcttccttggcttcccaaagtgctgggattacaggcatgagccactgtgccctgccaatttttttttttttaattatctgggcctggtgtcctgtgcctgtggtcccagctgctcaggaggctgagccagaaggcatcacttgagcccaagagttggtggctgcagtgctatgatggtgacactgcactccagcctgagcaacagggcaagaactgtttctaaaataaataaattttaaaaatgcaaatatccaccccagccccaccctctccccccaccttcccccacattactacatcggaatccctagggtgaggcatggaatctacattttaaaccagctcccaaggtgattgttccgcacagttccacgtcagtgtttgagagaggctctgatttattccagtcctctttctttacagagaaggaaagcagaaagcaggcaccagagaggtgaaatgagcttgtccaaggtcacaggttgttaaggtgaccagagctggacgaaaccccacctctctcgctgactagcacagcgccagctaggaagagcctagaatagcgaccaactggcaggccaaaccgtcccctgcccctgcccctgcctcggagaagcgggcccctgcactcacccgcttgtagatgtcctcccggctggcctcatacttctgttgcatgcgctcctccaggaagtagatgcgcagcttgaggctgaagttctccttcttcaggtcattgaggtgctgggacagagtgcgatatccattagacatgatgggcaacccatggggaggagcgtgcccgattgccccctcaacccaggaacatggtgcagctgcaccgcagcatgaagccagccggctgggacgctgctgaggctgcggaccgagaggctggggctacggcgacatggcccctattgctggagctctctccgggactcgggactgggctcactgctctgggtgctggagcgcagcacactttccttttttacctcagggagatatttgcggaatccctgacagaggaacatgctgcgtgaactcagacacaagtggtgtaacccgactccaagccaggactctgctgtcaccctcctggagcctcccaggcccaactgtaggcagttaacagcttctcggaaaagagagactgacccccaagagcttccaggaaagggggaggggagatattcaaggtgacagtgggtttgcaaagaagagaaggaaatagagggtggggagggggtatttaaatgacttgtggctgatttggactataagaccaaaaggagtgtggccagaagcaagaaataaggttgctatagaaaagaccatgtacataaaacggcccacaaaggtaaccgcatgtcaaatatcccctttctgtccagtgcaaatcttaaagagcttctaaccagaggagtctcaatttcctttgataatccagagctcacttctaatgagttcctttgcagttttcagccccaagctttttgagctctgaggcagttcaactaatagcctttattgccatgagccttcccccgaaacacaccatagctacccgcaaagaaagagcaaatcttctagctcagcggaatctttgcagactctatttaccagttacaaagctcagaaagaggcagggtcaagggatcctccctccatggaagaagggatgggcagaagagagtgtgggaggatgacagagagggagccgtcatcctggagcccaaagatttcaggcagtcactggttcttaactctggcacctgccaagtggagccgggcactcatcaccagatcttgctcctaaagtaatttaagatccttgagtgacagctgcaacattagcaggaagtattatttataccacattacattgaaggtgatgggagacaaccccagagcacagataacaaacacgggttctttgtggcaataatattaggttgaaaaaatatatattaacattcaagataaaggaaactacaaaatttacacttaattcaagccctcatttcctccccaacctacctgcttttcattcttccaattccttctcaaaccttcataatcattccagtcaacaactcctgagtactcaccaggtaggacattgggcatgagggatatatagatcaagaatgtcccaaccctcaaagagctacgtggccatacagctggccatgatatgttaagatatgtgttttacattatgatcctccaaacctgtgtttttcaacttttgtatgttacattgccatctagtacatatgcatacactcttaactgaagtaaatgtttcaaaaagtaattgtcaccatcactatgtgtgatgtcctctgatatttcctatttctttttctgccagtgacccacccgacggatttcatgacccactaataagtttcagcctgagtttaaaaaacgttgactctgggggagcccgtaagaaagagtagtcagttcttactggggtgatcagagaaagcttcattaggagttgaatttgcactttgccttgaaaaataaaaaatgtttgagtggataaagtggccccaggagggcataattagagtgaagcattctcccaaatagatttagattataaataggcaaaataggcaagcccaaatatttaccatttgaaaaaaaaaaactacacatttaaaatccatttaactattttcactaaatctgaattcttagaatttgagaatgccaactaggcttagttagagacagtgaagaaaaaagtctaagttaaaacaactcaaaatatccttttccattcccagttctcttactaaatagctatgttatagaccatttctctagaagcctaactgtcctcacttaaaaaatgaaatggctttaaaaattggtgattttttttttttttgagacagagtcttgctctgttgcctaggctggagtgcagtggtgcaatctcaactcactgcaacctctgcctcctgggttcaagccattctcctgcttcagcctcctgagtagctgggactacaggtgcccgccaccgcgcccggctaatttttcattgttttagtagagacagggtttcacagcgttagccaggatggtctcgatctcctgaccttgagatccgcccgccttggcctcccaaagtgctgggattacaggcatgagccaccgcgtctggccaaaattagtgatttttaaggccctttcctggtctaagctcttcaaggtgataacccagttaatatcacctccattttgctcaaggggagccaggctgccagagtttagataagtgtttaatcatgctttggctgtctacttagattcctttatcaggtaaaataatttcataaaagttttacaggaagtaaaactgtgtatgaatccagggtattcttatgcatcctagatttctgttggacatttatgcttatttcctccatgatatcttgttcttctatctctctggatccttttctgtgttttttgccagctcctgaaagtgggtatttaaatgatggtaagtcctcagccttctacttttttttctcttcacatttttatccatggaggttttatccacttttagggctatactttcaccttcgaaacaattcccaaatctccaaccgagtcttctcacccaagatctagccgtacatattcaactcttggcttagatcattcaacttgagtgttcccaaattccacccaagcaaagcctttcctcttaccctagcctggaaagacttcttcctcttttgaactctaaggcagatattaacattcaacaagtgttcatatgctgccttatgatgtggcttttgttatcttgaagggttatttacatcttttagggttacgtgactttttgtgtgtttgatctttccaactagtctgaagctgcccaaggaaaaagtcaatgactaactaatgcatcttcataaactcctacagcttccataacaacctgagacctctccaacagcattcatcccattgtgctgtcacagtctgtttacgatgacctcaacctggctagagtgttttgagagctgacaaggcatattttgtgtccttgtattcttgttgcatagtactcaggaagcactccctaaatatttgtggaatcaatgaacaggaaaatattccataaacattgtacgttttgctttgttatatatgggctggctcacctgtattattctcatagatttccaataatatgaaaaaagtttgttttaatagtcctaaataaactatatttggtagaacacttattctagaagacgtagaaaaatgacgttttgttcacttacatttctaagtttacatgcccaccctgatcttttccctgaactccaattgatatctgactgtctagtagaaatctctgcttgaatttagacatcacatacttgtgatatctaaaactgaactcctgatctttcccagtaaacatgctcctccctcactacaccttttttcaacttgtaacaactcaatattttcagatttttgagcccaaacctttgaatcatttcttgattcattctctctcctacatatcatctgtctgtaaatcttactatgcatattatacattatagtatatatattaataacatatatggtagtataatatatatgttgtagctgttgtattatgtatgtaatatataatactatattatatatactattatactactatatatatattttatatatatgttatactaccactactgccactggtatttctaccaccctgacccacagtactgccatcttttccttacatgatctgaatagccccttaactggtgttcctgctcccactcttgttcccttgtagtctattctcagcacagcagccacagtgaccctttcaaaatacgtcagattactcctctgctggagagccccctggcttcccatctaacttagagtgaaaggtgatgtcccttcaccagactgcaaggcctgaggccctacaccctcttcttgcctctcctattacctcctctacttcttcctaccactctccctctgttctctgctgtagccacactgtttctctttgttatttctcaaaaacaggaagcaagagaagctttcttttccgaggcctttgaacttgttgacccttctgcctggctgctctttctctagggaggtgcacgattctctcctcaccttcttcatctttgattgaatgtcaccttcttggtgaagtgaatactctttaggcaccccatgcctcatcccagctctccaaatcccccttcattgttttttattccgtagcactatcaccttctaaaatacattttcttatttattttgtttcttgtctgtctctccccaccagcatgtaaacttcctgagaaaagtgggatgttttcttagtttgttcactgctgtgtcaccagtgcccagaacggtgcctgatacatagctggtgctcaataaatatttgttgaattaaagaatggatgagtaattaacctgctgatttatttctcattggagtaatacaacttaatcgatacacaagattatgtagatgttttaggataaaaagcatacctagtagcattcctccttataaaaagattataagtaaaataaattactctaacagactcattttaatacaccatgcagaatctggactttctacaacagttccgaacaaatatggaatcgtatatgacaaattataaaggacaatatgaactgtacaaatagtaaaaactgggccaggcatggtggcttatgcctgtaatcccagcactttgggaggcccaggtgagcagatcgcatgaggtcaggagttcaagaccagcccggtcaacatggtgaaactccgtctctactaaaaatacaaaaattagccgggcgtggtggcatgtgcctgtagtcccagctactcaggtggctgaggcatgatgattgcttgaacctggaaagtagaggttgcagtgagcggagatcatgccactgcactccagcctgggtgacagagcaagactccgtctcagaaaaaaaaaaagtaaaaactataaaaattaggaaggagaggtggccagagaaggtaccacagagaattggcactttagcttgtctcaaaggatgagttgagcttggataggcagtggggagaacacaaggcagtccaggcaggtggaacataagcgaaagggcagtgtgcccaccaggccaaagcaaagggcacatactgtcctgaaataggccacagagatgaggggaaataaaaagccgtctcaaggagatcttgaaagccagggtgagaagcctggagtttgcccctccaggatcctggctctcaatctggataagagtgaggggaagggaagtggaggtggggaggagggcagtgggggtggggagggccaggaactgctgactgggaagattattttctttgtgtattgcttaggtttcgttttacttatttgttttcttgcagctttaacaaacatcagcgctgcatgtggaaacttggaaaagaaaaaaaaagctttaacaaacaaaaacacacatacctgagatgcacacggcaacctactagctcatggcaaacaggcctatatgttgataacctctgcattgcttaggaaataaaacactgcagattcttgagcaaggggaagtgcttctatctttgttcttcctttttctcctagtacatataacatctttactctggtctcagaatgtttcttccaaaccttaatggctctccccttctttttccttaatttcttcattccacccctggaataacgttctagtccagactagaaatacaacgtaaataaagactcaatcaatgccaacagtaggaggaggattaccacccagctgttgcctgtcatgccccattaacacaaccaaccgtcaagtctgcctttaaaaaacccagcttgacatttgcttcatcatattcagaccccccagctagctcatataatgtatgtacttgaaaacatattaattgtttaccaatctttctcctaaaaataaagcttcactaacaaaaaatgattaatcttcttaatggacacattcttttcaaatataatcaaacttccacaattttaactgtactaatttgatatctgtggataattcttacctttaccttccttgaaaataaaaatattttaaaaataagttaatacggcaaatagaaaaacagaagagtagtgctttaagtaacccttgacactttacatcaatttacacatagacaataaatatgatcactattatacatatttatctagggtgggtagcgtggaactgtgaaaagagcaatagctttgaaccatgaagaccagcgttcaaatcccggctctccttttttctcattgggtcattttggggaaactacttaatagttaagtataggaagacagtcagaagactgggatctgggcaggatactaagaaggttgcaactgtatctgtaatggtaacttttgttttttcacctgaggaaaataaactaaaaataatgttttctaacatttagatattcaacacatggacaagtgtttaattattctttgtatattcctgttgtttgtaaaacagcttataatttttaaaactattttaaagggaatgaaagtaggaattacagggaggcagttatcaattagatataaggatgaattctctagtagagttagatgtaataaagatattgccacactctatccatatgtttatacatcaaatttttactgagtacatacatcatgagacaaaataaacttcctgtcacaaaaggtgcttgaccaaaactcaagaatcacctttcagggatactgttaaaagttttcccacatcagctaggagttagctctagagggcttttaagatctttggccatcctgaaattctatgcttgaaacacgttttctcatagaaacgctcctaccaaaggccagtgagagaactatcactttgtgaagaatttcagaatgcccactagctctcctgtagccctaaaaggtaatgagagtctacctgttcagactgagagctccggctgccttgtgctacagaagcagtaagtgcatgtaaaggacgccatatttctaagacaaaagcagtaacaatgactcaaggatgatgcccaatagacgatttaacctataactttgctaattgtcatattttcaaaacagccctatgggaagggtacacaaatgtctggggagtatttcctgctttttagcacccagggaactacaaccaggagcccagcttattttggattggggatggggatagacaagaagagatggggcagggagaagagacggctggtttattttacatacacatattttatttataatacatctctgtgtctaggcgtctctatgctgttctcataaaatctgaattatacaaataaaagtttaattcctggctgttttggatgacttgggcctgtattacaaaattaatcagatacaattatactatcttcacaacaacaatcatctacattggttttgacaatgtacaaagtacttccatgtgtattatttcgtttatctttaccacaacctttgaagtaggaagacatgatgatccccattttactgcctaggacagagagacatcaggaggttaactgacttgttcactgagaaagcggaggagcacagactataactccaacagtttgaccccatactgcatacgcatcagggccttaatcatgagactgtatgacccttctgagcctgggattcacttgcaactgggtattccctcttctacctcaggccccctataccttttcaaaaagtgtccttcactgtaaataatcttcctggtggtgaccctaaaggatctgacaacctggatctatgtaaaaaaaaaaaaaaaaaaattgttttcttcattttcaagatgaataaactaaagttggctctcaaagggttaaacaaagagttaccatgtggcctagcaattcctttcctagttatatacccaagaaaattgaaaacatatggccacacgaaatcttatatacaaatgttcatagcagcattactcataatagccaaaattggaagtatttcaaatgtccttcaactgatgaatggataaacaaaatttagcatatccaaatcatagaatattactcagccataaaaaggaatgaagtactgatacatgctacaacacaaatgaccttgacagcattatacgataatgtgaaagaagccagacacaaaaggtcacatactgtataattccatttacatgaaatgtccagaataggcaaatccaggcagaaagtagattagtggtttccaggaaccagggagagggaaactgggaagtgagtgttaatgagtatgaggtttcctattggagtgagaaacacgtactggaattagacagtggtgatggttgcacaactctgaatatactaaaatcatagaattgtaagatttcagaagatgagctgtatagcgtgttaatcgtttgaataaagctttgtttttaaaagaagacaaagaaataaaccaaagctgagagaagtaactaacccaatcctttatcttttataagagtttttttaatgataaagactcagttaaagtccaatttgattcagttcagttaaagctaaatggcttagaatgaatcatgtctaaatattctgtataccaatcctacctatattatagggccctaaaagaagggtcagacgaagtatgctctaagtggctctcagtactgaatattcacagattaagttttacaaaaaggtaaagttttgtgataaccctcagataaaacagaaacatatgacctatgttttgacataaaacatacgtatttggcctgttctgaaagatatgtataattttcacacaccacattctaccaaggaaaatgtcaaccggagccaaccaacttggtgttccactcatcaactcttttatgccaacatggtgtttctgcccttgtctcagaagccaactactgatacctgcttcagaaaactgactatgaattccacaaagtcctgcttttttcttttggattgtacaatcaacaaacaagtcacccttctaaaactctgtttctgaaattttaacataattcctgaagttccagagtctcttaaatgctaaaatattaacaataccattccattttttcccctaacactcagaagcatactgatacccatcctgtacacagccttttcttgcctgataacaagagcactaatgacagagctattgcatcaggttgattaataaaccccgtcttaggcagcctcatcatgtggataaagaaaaggagttaagatgatgttcctgctgccttccccaacatagaaacacacccacaacacccccaatcctggaataaccagatgttatcttcatcatcacactagagcactgtaaaccacatcaaaacaaaacgaaacaaataacaacttccctggccaccaaaaatagatggcccagccagaaatagtgctgccagaggcagttaaatgagctgcaaggcaggaatgacagttgagctgcagtgatgctggggcctcccaaggattaccggactccaaactagattctccatcactttggtccaatcaacatcagcaggacttggtatttgttcacaattggttcaactcagattatttgctgagcttctggaattcagagagagtgacttatgggctcacctttttctctagattttaaataatcctttctccatttttttctaggagtgaaggcaattttgaaggcatgactacgacctgctctggccacaagagctaagagttgccaggtgttgtggctcaaacactttgagatgccaatcccaacactttgagaggccaaggcaggaggattgcttgaggctaggagcttgaaaccagcctgggcaacacagtgagaccccatctctacaaaaaataaaaaaacaggccaggcgcagtggcacttagggaggccaaggtgggtggatcacctgaggtcaggagttcgagaccagcctgaccaacatggagaaaccccgtctctacaaaaaatacaaagtttgccagtgtggtggcacatgcctgttatcccagctactcaggaggctgaggcaggagaatcgcttgaacccgaaaggcagaggttgcagtgagtggagatcacgccattgcactccagcctgcgcaacaagagtgaaactccatctcaaataaataaataaaataaagttttaaaaagtcaaaattatccaggcgtgatggtatgttcttgtagtcccagctactcaggaagctgaggtgggggatcacttgaatccgggaggtcgaggctgcagtgagccaagattgtgccactgcactcaagtctggatgacagagcaagaccatgtctaaaaaaaaaaaaaaacaaaacaaaaccaaaaaccaagagtccacagtgataccatgaatgcccatggctgcaacaataatgccttgaccagaagtagggggataagggaaaagatagagccaacatgaaccccgattgaccctcccttgctccatccatgacagaaagcctcctatttctgaattcaccaggctcatgctgcctccaggactttgcatgggtagcagcattagcctagaatttcacttctctttaattcccacccatctctcacttaactaatcccaactcacccataaggatctaagtcagatattacctactaaaagaaacctatctggccctaatgcctgggcaagggcttctcctgaatgcttccacagcactgcggacctactcttattgtggcccatttcacagtatattgggattatctgtttgactctctccccagtagatctggagttccttaacaacaggaagaatcttctttacttttcttccaaaaacagaaatcgctttactgttttttgtttgtgttgctgttgcttcagtggtcataaaagtactacatgtgcctgtctgttccagttgttctctttctcagtggagggcataacctagtagttgaccaagcaagaaaacttgacatcatttattcgttcaaaacaaacaaaaaagaagaaaagaaaagggcatgcctactatgtaccaggcattatgctaatcactgtatctagaagtgaaaagacaaccactgtccctgctatagtgagctcatgttctaacagaaaaggcagactttgaacaaataactcacgttattgaagagagaggtgaaggtagtctggaagtttacaacaaggtgacagtgggtaggatgtgagtgaagagatgaattggtgatcagtcgtctttgggtttcttcagcctcactggttctacatccagtcaatggcttagctctatcaattctgcctctgaaatttctttcacctgtccatttctctaatttttatactggcatctccaccaacctttgcctggaatactgcaactgttttctctgcctctagactactcctcctatgcagaggtcataaggaagccaaaaggatctttctaagaggaaaatctgatcatgtcacctctctgtctaaaagctttcagcagttcccttgagctcagataaaatttaaaagcctttacataacttgcaagactctgtatgatgactcctctctcttttctctggtttcagttctctgcattccttacatcccattctctaggaatactgactatggttctttctctcatcgggatcttgattcaagctatttcctatgcatggaacattcttcattctcacactaccacccccttattagtggctacttcttattccttcttcaggaccctggttagatgcagtttcctctaggaaactttccctgaatcccccaatctcttcagattgagtaagtgcccagttatatattccatagcactctttacttctattacaataataattacattctgttggaatttgctaatctgtagactctatgaaggcaggaaccatgtttgcctattcaatattgtatctgcaatgcttaaggtatgctgcacatagtaaaagcactagaatattttttcaatgaatagataattaaaataaatataatactcagttataaagaaggcaataggctaattccatcatccagacataatcaatatcaatgttttggtatgtatccttccagacatttccatcttttctccctcaaaaatgagatcttattttttgtaatattcagtcaaattgctgttgccgttgttttgtttaatcttaaatttgttataatggacatcctcccaagtcagtacattgctctataatgttctattgtatatatattccacacttgaaataatcctcaccttgagtactaatattgtattggtatagagaatactgaaatataaacactcatccttgaacatacattttcttttttttgttttttttgagacggagtctagctctgtcacccaggctggagtacagtggcaatctcggctcactgcaacctctgcctcctgggttcaagcgattctcctgcctcagcctcctgagtagctgggattacaggtgtgcaccaccacacctggctaatttttgtatttttaggagagacagggttttaccatgttggccaggctggtctcaaactcctgacctcaggtgatccgcctgcctcagcctcctaaagtgctggaattacaggcgtgagccgccacgcccggccgaaaatacatattttcatacattcattcttgatcattgtgcaactaacagctagaacatggcctggcacacacgatgcactcataaatggatgagtggattaacaaacaaatgaataagggggtcagctatcaataagcataataaaattgtggctaagagtttaggcactagaaccagtacacttatgtccaaatcccagctccagcacttgccatcaattactagtgttttcctagcttcagtgtctctctacaaacaaagacaatggttgtaccaacctcaaaagactattaggagaactgaataagataataaggtcaagtgcattctcagaacttggcacactgtaagcacttacaaatattaattggtatcatgatctttgttgctattttttaaatttagtattggaatggaaattatcattagaatggaaactttgcaaagtccacagaaagaaagatagggcttctcttcgaacaacgggagaagagaagaaaacaagttttaatgaggagacagaaaggagataatttaaaattatgaaaagaattattctaattcaagtgctacattctctgtgaaagtggttgctctcttttctgtgttggtaatcatacctttcagaatgttcagggttgtccaacttttgtaatttcattctttttgataaagtttctttattaattgcatgaccaaatgtaagctaatatttacaactttgaaaagtttacacacgcacacgcgcgtgcacaaattagaaaaaatgttctatcccagtatttaagatttatttatttatttgagacagagtctcgctttgtcgcccaggctggagtgcagtggctcgatctcggcttactgcaacctctgccctctgggttcaagcgcttctcctccctcagcctcctgagtaactgggattacaggcgtgtgccaccatgcctagctaatttttgtatttttaatggagatggggtttcaccatgttagccaggctagtctcgaactcctgacctcaggtgattcgctcacctcagcctcccaaagtgctgcaattacaggcatgatcaccacacctcgccatatttaagttttaaaaacatacattagtttggcaagtactcccatcttgaaatatctctttcaatattgccttagatgttatttaaattaaatcttgtataatttaaatttttttatgccccaatcagattgtacattctttgagaatggaatctcatgtccatctttgtatattctacagcactcagaagcattccttttactctgtagttctataagaaaaaaagtaattgatttgattcatatctttggtaatgttgcttaggaaagaaaactttgcatggaaagtctgtggaatgcctgtgtgtggaagccttctgtttccctttttaaacatgagattgaaaagggaaaacaaactgcacttgtgattgctgaaagtttaatatttaccccctgcctcctagtaactttttgaatgtcttaagataccagtgaaaacaaaaccagtatgtttgggacactgtggtttggaagaatgaatgcattttttttaaataaaaatgcacttcactagtagtattcattttccaaggctgtaattggagagaaacactcgagaagcaccaaaattgtggaacataaagagggcagtgacaggaccccaattaacctaaattagcacaggttacccagactgtgataactcagagctccagaaactccccaaaatgaaaaagccttctgcttttagcacttttttttttcttttttctccccaaagacttcaagattcaagtggaaaagttcaccaggatgggtgggacctgaacaggctgactcactgcggttagattcagactgccaaggaaagctgcagagtacagttaggcatacactacagctggttttgatgatattttcttgttaaagacaacattattaaaaaaatgtgtaaataggacagggcagtggaggccccctcttgattttatagccaaagactcccacccttccgtggcttttctgtaccgtctgccatgttgattctatgtaaaaaacccaaatgcaggcattccaccaatgtaatgctctccttctctgagagtcctttcatttccccaagagctttggaatcattggagttacagtggttccgttactttattcttatataactttgggcaagttatttgaaccttgatctcttcactagtataatggttgtaaaaataatatctatctcataagttaggaaaatgaactgaaaatacactaaattaaatatgtcaaatatctagaaaagtacctggtgcataatgagcactcaaatagtatttattgttattagctactattgtgatcttcttaataaatcctgtcaaatattatttcaaaaagactctttctctcccgtccttttcatttttagttttatcattccatttaaagtggaaaagaggccaggcgcgtagttcgcgcctgaaattccagcactttgggaggccaaggagggtggaccacttgaggccaggatttggagaccagcctgaccaacatagcggaactccatctctactaaaaatgcaaaacattagccgggtgtggtggcgggagcctgtagtcccagctactcaggcaggagaactgcttgaatccaggaggcagaggctgcagtgagctgagattgcacccctgcactccagcctgggtgacacagcaagactccttctcaaaaaaaatgaacaataaaaaaataaagtggaaaagaaatgtacatttcttgacttcctagtttcccatcctacccaatcaactaacacaccaataccctccttaaaactattcaacttattgtgaataccaggtagaggcagaagagatacaaatccaataggatatctaatttttaatacttttcagctagtttagttgatgaatatttactgagcacttactatgtactacattatgctatattctagagactagaaaagaatgggcaagaggtgttttctgccctcaaggagcttagagtcttggtatatattctgggattagagagtaagagaaggcatcctaaaattaaaaaataaataaatttaaaaaggcacctgagctgaatcttgaaggatgagtaaactttaaccaaataaacaataggagagaaaaggttttcaaggcagagggaacagcaggtacaaataaatgaaagtatgaaacagctttgaattgcaagcagttcagaattaatagagtaaaaatcatgtaatagagaatactggaagacaaaagtggatttacagtttacctagagaggcaggaatctggtaggatttcaatctgcatcaatctaaataggaggaactagtgattccatttccaaataagccaacaccttcattagcaccaaactttcaccagctgagttccccaacataggacatgcccactatctttaggtcacaaagacatcaggtgttttcaggctcaatcatgagttattgggcaagttcctttgttattctttttgccattagttcatcatttgtaaactggaataataatcatggcttttcttttttttattatatttgaagttctgggatacatgtgcagaacgtgcaggtttgttgcacagtatacgtgtgccatgttggtttgccgcacccatcaacccgtcatctatattaggtatttctcctaatattatccctcaccttgccccacagcccctgacaggcccctgtgcgtgatgatcccctccctgtgtccatgtgttctcattagtcaactcccatttatgtgtgagaacatagggtgtttggttttctgttcctgtgttagtttgctgagaatgatggtttccagcttcatccacgtccctgcaaaggacatgaactcattctttttttatggctgcatagtattccatggcgtataagtgccacattttctttatccattctaacattaatgggcatttgggttggttccaagtctttgccattgttaatagtgctgcaataaacatacgtgtgcatgtgtctttatagtagaatgatttataatcctttgggtatatacccagtaatgggattgctgggtcaaatggcatttctagttctagatccttgaagaattgtcacactgtcttttacaatggttgaactaatttacactcccaccagcagtgtaaaagcgttcctatgtctccacatcctctccagcacctgttgtttcctgatttttaatgatcgccattctaactggtgaacatgccttttcacaaggttgttgtaaatgagatcatgctgtcacatacttagagcaatatctgccacatagaaagtgatcatcaaatgctagccagtattatgtatgtgctgctgaagtcttgctcattccagagatgctgcagctgggtgctgtgatcagcgagaaagcatagggcaagggatttttctcaacacatcattgtgaccatttgtaggtaaaatttatttctgatccaataatgtgttcagatttatgatcatggtacataaacttatggccctgaaaaagtcacaatttccgtgagtcctggttccctcacttaaaaaatggggagagtgatgcttgttccgtgtcttataaagacaaaataaaacaacttatgagatacacttaacccactgctcaatacactaaacccactgctcaatacactaaacccacagagaatcccttcatcagtggattctctgagtggggaaaagcgcctacataacgaagttggtaaggttgggaaattaattaaatcactcactcattcaaaaatacaaatgaagcatatatgctaagcaatgccctcctttcatcatggagtgtaatacctattgacctcaacctgacaaacatacaattggagtttgtatacacatacaaccatgctgttggttgtgggtggagaatgaaagaaaagaaacactgttgtatgttggaaatgttgctttctttgtcccttttttctacaccaacataaatgataattgtcactttcgcttgttaattgactaattatgttttggttccataatgtgccagtatttgcatttttagtctgttatctctttccctgtaatcaaagagccttttttctctagaatttcctacatcagcaaacattttagaggtaactgcattactgaacaattataattacttttgacagattgagcacttttagtattacttctctcctgttctaactctctttttcttacctctctatagtccagtctcttatttgaacatatctctcttccttcccccaaatctcccctctgtctggaatattatactctacttccctgactagtaaaatctaactcagctttggagaccttgctcaacgtgaagcccccaggagaaatgtcctctggtaagaggcctttccctactcctttaataaaagtagacattttctctcaagatctcagagtgtactgtccttatctctatgaaagcacttgccatgctatattgtatttaatgcaatgtctgtacttccaaatagactataactatctaagggcaggaactaaagtatctcatttaatgtgatcatgtgtttgttgcatggataaatgaaataagaagggattcctggctgcttcttccaggcctgtctccctttgtctttaagccctggaggagtcgaccctactttggcaaaaaacatttagcatgtcccctcctctctctgagtactgctacctatcctatatcccaaggctaccaaatgcatattttaaactttacagaaaataccatgttatttagtattttaccatttttagggtagggcataggaatgtgttcctatctctcctgtattttttctaaccaatgttttctctaatttttaaaccctttcatggaggcgttttgtattttaggtgctgtcattcagagtccacaggatggatgaatggatatgaaaatgaacaaacgtgtgacacaacactgcatgatttacctgcaatgactttctgatcaagcctgaagtgggttgtagcctctttatttactttttatttgacacatagcagagagagatttaaactatctcttattggccttttccctgcgtcttagcttggtttctgtcagtgtttcccagcatcgagaaataaggactaatctgtcatattagatctaaactctaaaagaaaaggactttgggccttatatctgccacccattctttcaatggaggtgacacccctcatttctatatttccagtcatctctcaatgaaaaggaacatgcaggctggctggcctttggagagcaccccacacagttttgaggagctctgcagctctgcttgccctttctgcatcacagcagatccaaaaggtgaaaaaaaaaaaacaaaaaaaggagggggttggggtgttagcatccttgcttcccccaccagcaccacacagctgttcggaggtttagtcttcaaaagcctcttgattaccatgcaaactctccatgtcttaaaaaaaacatacacacagtatacatgagaatgctaagcataaaatttgaagaataggctgttaattcttaggcacacgttatatggtgcatattctttgcccacagaaatatctggtaggatgtacagaaagtattggtgaaatatttctacttacaaattgagggaagatggggtaaacccatgtcaacacaaaattttttgagattagaattttactttttttttttctgtcaaaagttatcaattccaattccagaatgagagaaaccccagtatctcacagactatttacacattatttatgtgggacctgcttgctgggtatccctgagggggcaccaaagagctatttctttcttccttttttttttttttttttttttttagagcacaagagtataagaaattccggctgcctgtttctgggctatttaaatcccagtagacatgctctcttgtacagacttcctgggctcaacccagctcacagggagctggggaatctgtattacattatcagttattgtttttggtcaaatctaaggacaaacatatgaagaagcagagcatgcagcactggttcaggaggttcaagcaacattatcagattcttgttgagaaacaaatggttgttactgtgccaccccacactgcagacaattcctagatatcgagagaggtccaagctagcaacagagaatttaatactagctgctggaccgggactcctgggctcactatgttgcagctacagattctcagaatgccatttaaacttcctgagtttatctgagaagtaaaccaagggtgtaggtgatgaggcagcatttactggtacagttagtccccccttatccacagttttgctttccatggtgtcagttacccacagtcaaccacagtctgaaaatgttaaatagaaaattctagaaatgaacaactcataaattttaaattgcacattgttctgagcagcatgatgaaatctcgtgccatccactctatctcacccttgaatcatccctttgtccagcacatccaggctgtatatatcgcccaccagttagtcactcagtactgtctgggttatcagattgttgcagtatcacagcgcttgtgttccagtaactcctattttacttaacaatgtaaaagtgcaagagtagtaatgctggtatattgttataattgttctatgttattattaactactgttagcctcattaacatttaatttataaattaaactttatcctaagtatgtatgtatagaaaaagacatagtaaatatagggttcagtactatgcagtttgaggcatccaaaggagggactgctgtacaggcaagggtccataaccacaccccccagcacacagctgacagagcatatgtttattgggacatgctcttgaaagagacaccataatgataataccatccataatccggaccaatccatgggtcatatttttatcaggcatcactattccatagtactgcttctaattgggataacaattatccactcacatgacttaccttctcaaagtctcgaagagcctgggtctgtacctgagggggtttctcaaatgctctcaaggaatatgtctgcacaaacgggaccttttcaccacttctccagatctgtgactgcactggagggcctcgatctttagtgtcactaagaaaagctgtcaattaaacagaacaacaaaaaaaaaggtttatataataacagcactaggatcattctaactggcacattccagcagaattcagtttctgcaaaatacaaactcaatctaggccacatagaaacagtttacttaaagtagtctgtggtagatcatattaatagccatccccagtgaatcaaactagtttgggtccataggcctttgcaatgtgatactcctgccattaagaagtagagcctatttccccaactcttgaatctgggttggcaaagtggcttgccttgactggcagaatatgatataaatgctactgtatgagttccagagactagctttgagaggccttgcatttctgctcttgccttattagcatcccaagacaaccatgctgtgaagaagtcggtctaccccactggagaaggaaaggctgttcagggaagtgaagatgccccagctgacagtcaccacctgccagacatgtgagcaaggctgtctgagaccttcagtctcagtcaagccatcagaaagttgcagccagttgagtgatcccaagtgagaccagcagcgataatgcccagtttgccaaaacagaattgtgagaaataataaatcattgttgttttaagccaggtgtgggcagacattttcttaaaggaccagacagtgttttaggcttgtgggtcatatcatctctggcacaggtactcaactctaccctgtaacacagagcagacacagaccatgtgtaaatgcatgagtgtcactgtgtggctataaatctttacttataaaaactgactgttggcccatgggctgtagtttgctgctgacccctgttttaagtcactaagttttgggatggtttgtcacataacaaaaggtaaccaaaacagtctaaaggaaagaaccaagctgctagcaaactatctctaccgataatttttcaggttactatttagtaatagtaacaattataacagccaacatatttaaagggcattacatgttacaaaatagtttcacatgaattatttcatttatgaagtcgctgcaatcagtgaaatagacataagtgattattaagtccattttactgatgaataagtaaagattcagaaagtttgcttgaccaagatcacattgctaaaaagtggcagaaccaatcccatcttttctccatctgtctttcttagcagtatgctactactgtgttattttagcaattaaagggattgcaataggtctgagagtggggaaaacaggtaaagaggcagagactcaatcactccattaaccaatggaagcattgctttgggagaacctagtggagtctaagctgtaattaaccctatgcttgcttttgagaagtaacattgttaaagaatgagaaagcaaagcctctgtcaaacaaagtacacagaggacctcatgttggggcagggttggagttacagacaggtagaaaacatagaaagctacatactttcttggctgacagaaggaaataatgaacttttattatggaactattttttaaataagaagacagtcatggcaaagcattaagcgctacagacagtgtcagggcaagtaagagcaaaacaggtactgggtgactgcctggctgaggaaaagttaactagacacttggggaaaggagatccaagggagtaagaggcaaaatgcctttgcatgcttttcttcctatctctttttctttctctccttctcactctctcccttccttcctttcttcctttctctttctttttttttttctcttttcccccacctctctgcctgcctccttccttccttccttccttccttccttccctccctcctctctccctccttccctgccttctttccttcgttctgccaacttgccagaaggagcccaagaaaaagcacccagatgcttcagtcaacttcttagaattcttcttttttttatgttcagaaaagatggaaattcatttctgctaaagagaaagaaaaaattggaagacagggtgaaggtgaacaggcccattataagaaagaaacaaaaatctatattctgtctacaaggaaacgagagagagaaagagagagaagaaagaagttccaggattctaatgtaccaaagggatctcctttttcttgttttgttctgaaaatttcaccaaaagagcacaggagaacatcttggctaattcattggcgatgatgtaagaaaactgagagaaatgaaagaaatgaagaattactgctgcagataatatacagccttgaggaaagaaaggcttttaagattatagatataaaggctattgctgtattctgggataaaagaaagtctgatgcagggaaaggggaagttggaaaaactggaaaaagaaaaaagaagaaaagaaaaaaaggactggaaagacattggtgaatagaaagatgaaaagggtgaagaaaaaaatgatgatagtcaatagggtggttttaaaagaggcttttgttttattaatttgtttttgtgtgagtgtgtgtgtatgtgtttgttttttgcctaaaagtatttaactccgcattacaccactgatttcaaagaaaaaaagctgaaatgtaagatcatatgatttgtttttaaactgaacactgtatactgtctttttatttttgcaaaattaatgtagtatccagtgtgtctttagataaccctgtccttaatgatattttcaatagccactaaccttgcctggtactgtttcggggtttaaactagaacagaaatttaaggcaggctttattagtgcatagtacaaatcaattacatatatatggagatattatttttccctcttcaattgtttttcgtgcagcttacccaatataattgttctgttagttgtacactactctgtgatagcaaataataataataaaataattatgatgatattgcccctgttttggtgatattctgaatgtttatacgtaaatgcaaaatttttaattaaaagtaattagaggctgggcatggtggctcacacctgtaatcccagttttttgggtggttgaggcaggtggatcacttgaggtcaggagctcaagaccagcctggccaacatggcgaaaccccatctctaccaaaactacaaaaattagccaggcgtggtggcaagcgcatgtaatcccagctactcgggaggctgaggcaggagaattgcttgaacctgggaggcggaggttgcagtgagccgagacggcaccactgcactccagcctgggtgacagagcaagactctgtctcaaaaataaataaataaataaataaatgtaattagaaaaaatgatttcttccacatttaggtgaaattaaatatactactaaggggaagataatctgataaaacagaataacaatacattacagttagattggtggatatgatagaaagagcaatgccttgaggcttggatttgaatcctgaccacttgctaattgtgggaatttaggcaaatctcttaattttgctgatatattgcctctgtaaaacaggggtaataatatctgctttatagaactgttatatggattaaataaaataataaaagcaccttgccacatgtattatatgtagtaagcattttatccattcccctcacatttttgccctagtccttcaatttttgcctcaaaatgtagaatattgacatttaaaatgttgagcacagtaacccttggaatttgtggatttaacacacatttcaaatactaattttaagtgactctgaaattcttaacttattcaaattaaaaacttttttccaaattgtgcatataaacaatctgtgcttccaggctgttatgaaaaaggcaaagaacttagcaaggaagtaaaaccctcaggtcgagaacaagttttgtggaaaatagaccccaaaagaatgttatcttccctttggttttgcaattcaggtagatctctggctaatgttagtgtagtaataattgtgctgttgttaggaatacattaatagtgacaatagataagatacagagtgcttattccttgatagcctctgtactaaaagcttttctcaatctcacctatgagattaacattattattatacccattttatttatttattattttattattatttaattttttttgagactgagtctgctctatcacccaggctggagtgcagtgccacgatctcagctcactgcaacctctgccttccgggttcaagagattatcctgcctcagcctcctgtgtagctgggattacaggcgtgggccaccatgcctagctaatttttgtatttttggtagagatggggtttcaccatgttggctagcctggtcttgaactcctgacctcaggtgatacgcccgcctcagcctcctaaagtgctgggattacaggcgtgagacaccatgcccggcctattatacccattttaatggtgtattaagataaagatttcattttagtaacataatttattttaatcattgtacaagtgagtttagccttgcaattacagaatcgttaaaagtatgaagaattcacataagtatctgtaatgatttactgtactatgctgcttctcagtacatagaattatagctagcttataattctcgtgtgaaattgctacagtagtatgtgcaaatttggaaattcacaaaagtttgaagatattgccatgatgaatttaaagaggccataattcaagagaattaagatcaatagaaaaccaagaattggccaagtgccaatttctctcacacactttggaaagctggagtgggtgtattgcttcaggtcagacattcaaaaccagcctgagcaatatagcaagactcccacctctaaaaaaaaatattaaaaattaggcatatgtctatagtcccagctactcaggaggctgaggtgaaaggatagcttgaccccaggagtttgaggttgcagtgagctatgatcacaccactgcactacatccatagtgagagagtgagaccctgtctcaaaagaaaaccaaatgaataaacaaaagaaacaaagaatttaacaaggcaaggcccacagcatccttacctgctgtgtgactcgttctgggtaccatctccccatcatcctctgcaaaataatctctgtggaggcaaacacatcattaattaatgagatactaccccacaaggctcccatcccagggatcgaggagaagacacctacctatttgtcatttctatttatctctctgcaagtatttactaagcttctattatgtatcagggaccgtgtcaagtgctagggatacaaaggcaaacaccacagaagagttcctattctcaataagtacatgagagccagccattaaataatttcacaagaattaactactattgtagtaaatgttgtgaaggaaaatgcagagggaacttaactagcacagggactcagagaaactcagggaaaggaacatttaaacgtagatgggaggatgtcaaccaggtgtagaatgggagaatgggagtggaagagtgttccatcatgagagaacagcaaaggccctgagtcagaaaggactctggcctgttagaggaacaaagaaagccaatgttgcaaccaggccacgcaggaccttgtggtatggggtaaggccactgagtctaatgtgaaaagctacgggaaatcaatgaaggattttaaattaaggaaagaatggcaatgatcagatttatattttagataggtcattccagctgcattctggctctacacagtgagactgtggaggggcaaaaatggatggtgagaatctatattccaaataggaagttgtgatggtttaacaaaggggaaattttaaaaatttaagatatgtttagaaagtagaattgacacagaaaccttgaaaaatagacaaagtttatgagtggaaatgttaataacaccatgattcagtagcaagaggtgtatctgttcagcatagtaaataccaccatccctagcagagaggggacagtatctcaaaatgtattcaacaaatacttctcaagcccatgcttgacaagtgcttttaggcactgttgtaagctccacaaatgtagcagtgagcaaaacagacaaaaatccctgcactcatggaatttttacagtaaggggagacaataaataaattgtatagtagcagttgggaacaagtgctataaaaaaaaggaaagtggggaatgtggatagggagagctggaggtaggaggaggtagaggggattgcaattttcagtagacaaggctgctctatgaagccataaggacaggcatgggggtctctagggaaagagtcttctaagcagagaacataaaatgcaaaggcccataagagggagcatgctagttagtggctgggtgcagtgagcacgtggtgagcagtaggaggtgaggtcagggaagtaatgggaagactgggcagggggcgcagactgtttgaagcctttcaagacatggagaggcatttagccactagagtcttgtgaatcaaaaagaaagacggactcagtgactaatgttttaaagggggactgtctactgtcttgacaactgactgtctgatggggatgtcagaaacagatgatttcaataaccctacagaaagatgctttcaataggtagcttattctttaaactcttgggggctcccaagaattctgtaaacagagatgtagaggacttctctctttctctctttttttttttttttttttttgagacagagttttgcttttgttgcccaggctggagtgcatggcacgatctcggctcaccacaacctccgcctcccaggttcaagcgattttcctgccccagcctccccagtagctgggattacaggtgcctgccaccatgcccggctaattttgtatttttagtagaggcggggtttctccgtgttggtcaggctggtctcgaactcctgacctcaggtgatccgcccgcctcggcctcccaaagtgcagaggttacaggcatgagccactgcgcccagcctacaggacttctctttttaaaagccagaagatattcacagggaggcagaggaggacctggcatttgcttggaaattggtggttttttcttccctgcctcagggctggatcttggcagaaatcttcactttgttaagtcccagatggacatgaaaataccagacagggcacatcgggctacacatgccacctgacaattatttcgtatccaaaagtagatcaccagcttgtgattcttccaggccccctgcctctttcccttctcctccttaaaagctttccctgagagtaaacaatgccaaagaggaatgtactacgtatgcactcccctctgtggaggtaaaataggagaaggatgtcaaaaccatcaaccagaacaatgtcttaaaaaaatctgtggggaaaaaatttatacttagctgctgctattcactgagcatttctgcctagtccacagacaaaggtggctgcatctgctgtcaggagcaaggtcaaccctcaggccaaattcagcccatccgacatgttttatttagcccacacaagtttgacccacttctaactgctcttgggaaatgagtgggtctgccaacactgggcctgccttcccacacagcgggagaacttgccccctttacacaggacagggatgtgttttccagtttgccacagtccctgccactccctgtccttgtcgtccctcattcacttaattatgatacttgcctggcatcttgcaggtttctgatgctgttaccccagtatagaccaagtgcagacagaatttcatttctgctttattaaggcacagtcttgagaaacccattggcttcacacacaattaattaatttgtggcaacaagctactatattggcttgcatgtcactttcacctctctgggcattagttttctctaatatttataaaagaaggacatgactttctaaggttccttgcagtaattatgcagttctattctaatagatgcttaagcataaaacccattttaatactgtccaaggatccaggataccttccagacatgatctcactcaatcttctctgctctgcagattgcacattataggtcaagagcaagctacaacacagcaatacatatcagccctaccagacacctcacccttcccgcatcacccacacccactctgagcacactgcctgcctgatatgaatcaataactggaaggatagagaggtcactttagatgggtactgagttaataagcatactcgcagtgtctcaggagatttttaagaaatcactttagctctattaacagctcaagttccctctcttattgccagagaaaggggctcactcagctgctccacaagttacaaaggaatctgacgctccccaagggaaggggctcagactgaagaaacacagagtataagtctaaggggttgcaatttgtgacaacatttgataaaccaaagtgcaaggagaattggggtatggtagagacagactccaagcatggacacacacacacacacacacatacacacacacacacacacacacacacacacacaaagtggtaatatatgttggtacattctttcgtattacccaagttcagaaaaaaattttatatccttgtcctagtttctcaaattcaagtgtctctagttttttaaaatatcaattcatgaatgactcatgctcagctaatatgtggttcaccaggccacttttagctctcctgcatttccatatataatctttctcccatgatgctttcacttaaaattttgctttttctgtataaatgaactatatttttcctcaatgtcttaccttgtctttctccctacgtcatcaatctgctaatgacaataccaattccactaaaaccacatatattaatattctcaccaggacattattttgctttcggaagtaccaagcattttccaagtacaacctactcacaagctgttcacctgcttgatttctgcatggtatatcactcatattttcttgagttgctgataagtagctattaagatattagactcaaataacacatcaacattcaatatcccatattacttggtttttctatggctttccagggtgattaagttgagaatgatcaggaaataattgcttctctgaaggccatctgccaccccctgatattctgacattctcaaactgtcctgtgatgatttcttccagtaattttctaagaatggtagtttcatttatggccagggttatccaaaacactcagttttgctttacttgaaactggccactgatatagctcctttcaagattcaagcatctcattggtcccactagtctagtttctcataacattgtggggaggggtagacacttgggtttcttcttgcttaggagcctgcagagagagatattttctataaggcaggtatagaccttcctccgtaaactgttatttctggtattattttcttgtattttagtctgtctaatttgtggactgagaggaacaacagatcatatgaatgaatcatctcattcaaaagcaatgacaagatggtaatcatcattacaaagcaggttctatgagtctttgaacagtatgagatatttgtattctaggaccaaaatcaccactaaaactatttctaaggtactgatgcctgtctaggctccatactttcttctctccagtctcacctactaaaataattaacctaaggttatttattcccatatgagtgtctaaactcccaaaggaatggtgattttcaggccctctcttcaggccaatcacaggtatttagtttgttctgagaaccacatagtctggccctcctacttcatcactaaccaccacccttgcttaacatttctaagcctgaagaccagggccatctcccagaggtgttttctagctttcaagcttctttatatatatatatatattttattattatgaacaaaaattcagaaggagaaaaaacaatctgctatagcaatacctagagcgaaaacctgggccttcattgctatttttagggtttttataattccattttgtaaacatttattgagaagttgcttatatgccaggtactggaaatacaaaggtgaaaaagtatatataccctgtggttaaagtactcagaatctattgagggaagcaggcacatgattcagagagataattattagaaaaattagatttaacagagatttcagaacataaataagatagcaattaattttgtcctggtggggagtgggctgggacagggtggttggcggaggggtctaggacatttacagaaaacagataacactgaatctaggtcttaaaggatgggtgtaaatacacaaggaaacataacaaagacccaattataggaaaatgaacggtgtgttcagggggctttcattttgttttccccttcccaaccaccccgctccatcttccccccaccctgaggagccctgaactgcctcctaggacatcttccaacttcctgtttacctttccccctcctcaagccttcctccccaagcgctcaccctcaggtgggaatatgaagggaagccaagggtgaaattgtttcttcatttgcacctccctcctcaaacactatagcttagaagcccccaaaatgatttaaaataatgtcagcaagaaaggggctaagatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaagaaaggggctaagatttgcactattgtgaaaatacccatagaaacaaactagaaaagaacccagagaaatgaaaagtccggaggtttagagtggcggaaaatatactgagcatcctccccctttttttcttactatttttgccaaaaggctaattcttatttttaaaaagtttgaataatctatttttattgaatttacattgctcttcctaattaatgaccttgataaaagataactatggaaaggattcggctcggtgtggcctctcaaacagtgaggggcgtgtggcatgacagcaagactgctgaagtttgctctttcttggggtcctcacaggagtaggcattgaaccaaatgcagattctgttccaattcccatattcttggagctcatttaacatgagttgctggtttctgtttcaaatgaaataaatttttcaaacgttccaagatgcatttttcctatttttaatttacagctatattcaactgtggcaaacacaaaagggtcagaatgagaagaactgtggcctattttttaatatgggaagctctggccctgacagtttataaatggtaagattttagaaatagtgtcaacttaaaaacaaagacatctacagttaacaatttctggactgctggtgcataattttataattccacaggttttcttgcactggaattttcctcaatactaatcttgtattaaatgaacatattattatcatggacaaccatcaccactcaccaccaatgctgcctctgcaatttactgaatgcctgatactttctaggcatcagttcattcagtcatcatagaatcctgtgaagtacgtcatacaatccctgtttacagatgaggaaacaaggggcctggaaggataaagtaatttgcccaagatcgcacagctagttggtgtcagagcctgaacttgaaaactgtctatttgactccaaacttttactcttcccaatatgccctatttctaaccacacatttacagggaacctcctttgtacctgccttgactccagggaactcacccctgagaagctgaggcgaaaggaagggtggacggtttgctgtgctgatgagatgggatttttgtctcaaaccctgacacaaatttgtttcttagactatcaacttatccctgatgggcacagcttacacttgagtatttgagtactggtgtaacagatgccatgtgacaaaataattaaaatcccaaaacggaagtggctagtgtgactttttatataggtcctatcgtgaaaagtgagtcatccatcattttatacttctctatctctaacccacttttttcagaatatttacatctttctccaacccctcccgtgataacacttggcattgtccctacccaagggaataaactgaaacgcgggaaaggtggtggaaacagaaacaatcaaagtggaaaaggcattagtgaacaagctctgagacttctcagatgtgtttttttcctcttgccaaggagagacactggatatattttctatgttccaaatgttgccaaataccctcccacaatgtggcacccgaattgtaaaaacacatattcaaatgcaaatagggtaaaagccccagatgcagaacgttaagactattatataatacagtgaaattatcattttttctcatctcaagatctatcattataacctctgcaagtgaggatgcttaattggcaaagctcccagaggagagagagcatcacggtgagcctccttctgcatgctgactaagtgtgggctgacttggcaccgatacagaaacatccactttattccagtataggctgcaattacacccttcactcaaagtctattcactgacagtgaccatcactctgagaggctgttttctgcagtgctaagtccccaatagctacagtgagctacaaaatcatcgtgcatccacaacaatttctttaagtttcgggatctttgttttgttttgtttttggtccagcactaagtcttcatcctaaagaaaataaggaaactaacattactttcttgatgctatccatcaaggttcagagaaaccccttaataagtaagtaattatttttcctcactttaccttctgaggtcatcacatatccaaatatctaataaattttcctctacctcccctgcatcagccaagacataggtatcactctttcaaaagaagacatgaaaataacctgctttggattcagtcacattaccccagggatggtgtatggtctctccacccacctctgaaacttaccttttgcattttgcttttggtcctggcaatgcaccctacaatcctcagttttcattaacaactaatatccacaaggcactggagtatattgcagttggctcaatctttctagagccctagactgaatgttaagaaacaggtgatttttttcccctttccacctacttttatattcacataatctttcagtttcttttctttacaatgtctatttttgatgattttaaaagaagtacatgcctcgtagaaattttggaaaagagaaaagtgtacagagaaaaataaaaataatctttaaaattctaccacctgaaggcaacattgataaagatttgtatgtatttagttgttcttcagtttatttgcctgtgtgaattctgcaaatggaaataatattgaatgtaacagttctgcatcttgcttttatttacactacggaaatcaaaggttgtgaggaatatatttttagaggaagagaaagagtcagggaaggaggagcaggagaaagaggcaggtgggaggaggaggagaatttctcagcagcattatagacctgttgaggattagcaagaatgaatctagagtctctcttctcagtgcggttttataacatactaaaacaacactcatagaatcctctaggattttaaaataaaattgactaagggttaccaagccgggagatggttaaggcagttagagattctaaagcagcgttgagaacacgattcaaagagctgactctgacgtctaggttcagtatggaggtgaataaacagcagatggcctggaagatacagagagttgaggaactggaatacatgacgcagtaaacaacattcagaaagaatgaggaagtggggaacttgacctgtggtcaagaagtataatttcagcattaaggatcctaagggtggaaaatctggaagaaagatgagctacaaaagatggctgtgctgatagcatactgaagtgaattcgagttaaggctatgtcaggtcaaggtataacagtgatgtatgtccatgcctagtgacccctctagaatgtcagtctctggaagggagggtttttagatcattcactatcatctgtccagcattaaagaagtctagatcataggaattggatgcgtatttcttttttttttcttttcccgtaactgaggaaacaagacacatatttcttaaacaatgataaatacaatctgaatgtataatggtgtcaagtttgataacctgttgtatccattctacaataaggagacacccaccaaacagatattcccatcggccttttggggaatgttctctggaaagctcttaatagatgaccttctaagtgctagaggcaatgttagatgctgaagacttatagacaaaaacgtttcattctgccgataaacttggagtatggaaaatatcaagttaaccaactagctacatgctacaacagagtaggcagagcgtgttctggctacacccagatctaggttctaaaaataattcctaaaggaggtacttctgaatctaacctctgaagggtatacaaatttatcccagcaaaggcaaggctagatgtgtaggtgggaacaactggtatattaaggcccactcataataattttagctcagggtaaattaagtcgcaatgactctccaaccagctccccgggtctgctggcaataatgctgctcctgtggtgccaataacctgaaaatctccaagtaatacaagaaagttatacacagaaaacctccaagtgatacacagaaaaacctaaaaccaactcaattccaaactttacatgttgtcatttggtagacacaaatgtgaacttcttcctgcaataaaaacctatgttgacttagtttaaaagcagcatataaaggatgttgcccataatcccctaaccaaacaaggcatctattttctcttttctctgtccttgtaatagacatcctaataggtatacatagttttgatgtaatttacatctatcttttactttcttatgttaaaattttctgtttattatcatttcaggaaacgtttcaggatagtaatagagattaacagcaacagtgaagcattttaccctagagaagggtaaaagttggaaatgttgctattgattcacctaggttatgccactttaatgtcagtgtgcctcagtttccccctttacaatacagggattcaggtcttgaaaaagatatttaaattgaatgcaatatctttcttatgggactataactttaagtaatttgcaatgtactttcaagaactggaaatgttgacatagttattctacttctgaacatctctcattcaaaaaataatgctgtggaagaagatgctttatgcacctagacatttatcaagtattatttataatagttaaaaattggaagtctacatcctttgggttaggcgtaatgatttaaaagacactgtaaatccacagcatgttattctacattatgaatgataatataccacattatgaagtggaaaataaattcattcttaaattgtgtgaaatgctagaaattattcaattttctttgtgagtcaatgctttctagttttttttttttttttttttttttttttttttttccgacagagtcttgctctgtcacccaggctggagtgcagtggtgtgatctcggctcactgcaacctccacttcctgggttcaagcaattctcattcctcggtctcccgattagctgggattacaggcaccccccaccatgcccactaatttttgtatctttagtagagatggggtttcaacatgttggccaggctggtctcgaactcctgacctcaagtgatcctcctgccttggcctcccaaagtgctgggattacaggcgagagccactgtgcctggccagtgaatgctttctatatgtcagaagttattgcttctttccaccctttccaccatgaccatgataagaagacactagttgcaagttacctcttccctcactggccttggaaaagacaagaaagaaagacgtttctgtggaatgtaacaagcagaaaaggactgaagataatgagacagattaaggaaagatgaatcacaggctgtgaaagtgctatgaaaataaaacagtattattatacaatttattataaatagtctatgactaatttagcactttagccataagcgttcagaaaaaagaaattcagatcatgcttgtcttgctggccacagaactcagaaaatgctctgaggcagaggaaaacaagtcctcagtgcatttgagtgttttaaaatagaatcacatagagccaccttgggtcaatatgacatctcttgtattctggactttcttctaactttaaatgctatttgaatttttgccagagacaacttgtggaatgttctgagcccagtttggaattttatttataaaatggggtagatttcaatagaagtagtgtcctggggcatccactgaatggatggatgctccacttagccttgaaaatatgatccctcagccacagtcaggcgagcctcccaggatggggacggcaccatgaggtgttacttatcctttctgagacaaaaacaaccccttcccagtctttaggtattttaaacatagtcttagcatgtagctgaaaaaatgggggttgggggagtcaggtccagactgatctagtgtgtggaaaataagcaagtaggagtgaaagcattgattctggcaaattccccaagccgaaatccaagtataggcccatttaaaagtagactggagttgccaaggcagaatttccttcttaaaattcagataattagttgctagcagtgctgaatattaaacaggaaattcaacttccaaagatgtttcaataatagaattctgaaaacaagcattttcctaatatgaagtgttacatgcaaagcaccagcaccataataagtaaaggtactggaattaactaggccttcatacaacacatactagttgtgtgaatgccagcaaatcatttaaccactttaacctcagtggccatatatctctggttgtaactatgtctttgtaaacaggactctctactaactcaccataaattcagagaaaaataaatgtccctgattcctctaggctaaacatttatatagagaaaaacaaattcaaataagctatcaatggagatctgttaagtacaatatagctgtggtaaatggacaccttgtcttgcttgaaggctgtactccagaaaagaaacaaagtcaaaattcttaaattttgaaaccagatcattaattttcttgaatgttacttccattttccaaattttcacagatacagcaagcaaatgcaattaatgcttgcattttattaaatcaaattgcaggggaatagaaaacaaaacaaaacagactaatttgctttccttttttaaccttcagtcttatagtttgcccttaaacatttctagttcactcttttcttgagttatgtgttcggggaagttgtataaggttcatatatgattcacctgatgtttactcagctttctcatatgctagaaaccagaacatttccactgaaatggggaagataattagtaatgactttttcagcattgaacgatgtggtaggctaaaataatggccttataagaatgtccacattcctaatccccagatcctgtgtatatgccactttccatagcaagagagggctttgcagatgtgactaaagattttgagatgaggagattatcctggattatctggttgggtccaatgtaatcataagggtcctagtaagagggacactggagggtcagaatgatcaaaggagatgtgatgatagaagcagaggccagtgatggcattgctggaaggggctatgaacccagaatgtgggcagtctctcgaagccatgaagggcaaggaacaaattctcctttagagcctctagaaggagcacagtcctgctgataccttggttttaacctagaagaccaaatttcagacttctgacctccagaactttaaggcaatacatttgtattgttttaagccactaagtttgtggtgatttggctgggcgcagtggctcacacctgtaatcccagcactttgggaggccaaggcgggtggatcacttgaggtcaggagtttgagaccagccaggccaacatggtgaaaccccgtctctactaaaaatacaaaaattagctgagtgtggtgccatgtgcctgtaatcccagctacttgggaggctgaggcaggagaatcccttgaacctgagaggcggaggttgcagtgagccaagattgcaccactgcacgctagcctgggcaacagagtgagactccatctcaaaaaaaaaaaaaaaagtttgtggtgatttgttacaccagcaacaggaaattaatacaaacagtaatcctgaagtactgataatctttaaagcagaaggtgtagggagttgctagtccagacaggtggatgctaaaaatttagagcagtagaagctgtttgcctggttgacactggacctgccgggtgagaaaacctcccctcatcatcaagttcttcatcagctccatgagcttattcttttgacaactctcgccctgttcacggaaataaatctgaaagctggtgaccaaatcagctttttgtaatgccagtatattcatagaaaatttgctattccagagccaaccatgctctgtccaaatgatttaaccagtgagtttggcaacagtcaggtaacggccccagcgggtagggggaacctttccattgagctgtagaggggcagatgatgtgtagctgggagtagagcatatctaactttgagaactaaaataccaagcaccttgtcctttgtgggtaaattgagcaagtagctagcttcagaaacaagtcataaactgagtcacctacaaaactctactaaaataaagtaaaagcatagattttggaatgaaacagttcaaggctatatttctttctcggctgtgtgtgtcactctgggaaaattatttaatctttctgaagctcaatttccttttcttaaaaatgagtataacatttacttcatagggttgtaaggattaggtgaattaagtattcaaagagattagcacacaattaaagcttaataaatgttatcaattatggttaatttttattctttcaatcccctatccactgtgtacccagagcagccactgcgtatctctgccttagtgtctctctattaaaattatagatgatgacaatgtaaagccattaaaggcagagacccagtctcattcattgcattcattgttttattcttagcatctagcacagcgtctgacctgtttggggctctcaaaatttatttatttatttatttatttttgagacagagtctcactgtgtcacccaggctggagtgcagtggtataatctcagctcactgcaacatccgcctcccgggttcaagggattctcctgcctcaggctcctaagtagctgggactacaggtgcaggcaccacacccagctaatttttgtatttttagtagagatggggtttcagcacgttggccagactggtctcgaacttctgacctcaagtcatccacctgccttggcctctcaaactgttgagactacaggcgtgagccatttcatccggccctcaaatttttaataagtgtttatgaactaatctgatctgtgagttaggaaggatctgagatgtcagccatgatctgtgattataggatttttccaactgtgacccattaggtggagaaataaattcagtgaatcagagccaacattttatttttaaagaaaaagaatagaatagcaaatatcagagtgcaaaacacatagtaaagttaagtattgttacaagaaactttgttacatatgtaagagtacttggtggcaatgtaaatatattacttattgtgagtagtggttaaaaaatatgtgaacattctgaatggtccaccttgccagcatttgctactttctatctttttaatttcagccattctgatatgtatatagcagcatggtgttgtggttctaatttgcatttccctgataactagtgatgtggagcaccttttcactatgttcttccctttggataccctctttttttttttttttttttttttttttttgagatgtaggctcgctctgtcacccaggctggagtgcagtggtgcgatctcggctcactgcaagctccgcctcccaggttcaggccattctcctgcctcagcctcccgagtagctgggactacaggtgcctgcaaccacgccgggctaattttttgtatttttagtagagacggggtttcaccgtgttagccaggactatctcgatctcctgaccccgtgatccgcccgcctcggcctcccaaagtgctgggattacaggcgtgagccaccgcgcctggcctggatacccgctttagaaatctcttttgtaatctgtttaaaaaaaaacaatctggcagtatttactaaatctgaacatgcatttcctattacgcagaaatcatacttctacttatttactcaacagaaatgtgtacatatgttcatcaaaagacctgtacagaaatgttcatagcaacactgtttataatagctccaaactggaaattgcccaagtgcctattaagaatagaatggacaaataaatttgatatatttatacactatagaagcctatttaaaagcaagaataaatggactacagtaccatataacagtatagaactccaaaagcaaaagattgagtgaaaggagccacgtacgaaagagtacatggtgtataatttcatttacataaagttcaaaactaggcaaaattattctatggtgttaaaaattaggataatgattatccttgaagtcatcaggagggcttcagggatgctggtaatgttccctttctctatctgaatgcccatcccatgagtatactcagtttgtcaaattaattggactgtaaatatataatttgcgatttttccaaatcatttctgaatttgtctgaaattgttacatgtaaatataaaatttttaaaacttaataaataatacttttttcttcaagtgtgaaaaacactggcagagagcaaaaggccctgatacactcactcccatcaccatcaagtggtcatctagcctttgcctgagtaactccagggtcaacaatctctttactgcccatactgcccaggcagctaacttgttagaaagcttttttttaatttttttttgagacggagtctcgctctgtcgcccaggctggagtgcagtggcgcgatctcggctcactgcaagctccgcttcccgggttcacgccattctcctacctcagcctcccaagtagctggtactacaggcgcccgccaccacgcccggctaattttttttgtgtttttagtagagacggggtttcactgtgttagccaggatggtctcaatctcctgacctcgtaatccgcccccctcagcctcccaaagtactgcaattacaggcgtgagccacctcgcccggtctttttttttttttttttgaggcggagtttcgcttttgttgcccaggctggagtgcaatggcttgatctcggctcaccacaaacttctcctcccgggttcaagcgattctcctgcctcagcctccggagtagctgggattacaggcatgtgcgaccacgcccggctaattttgtattttagtagagatggggtttctccatgttggtcaggctggtctcgaactcccgacctcaggtgatccgcctgcctcagcctcccaaagtgctgggattacaggcatgagccactgcacctggccagaaagctttttctttacactgagccataactcgcctcccaacaactcgcttgcatcggttgttctgtcctcctaagagattctaatgtgattcaatccctctaccaccaatagctcttcggaaatttgaaggaagctaccacatcctccccactcccagtcgtcatttctccggactcaggagtcccaggtccttcctttggccatccctcaaggcatggctttgagttccctcctgtctcttgattgtacttattttatctaatgatgcccagaactaagcacagccctctcggagaggcccaagaggagcagaaaggagccaaaagtaaaatcatcacttttgatctagacagaatctagacagcctacttcttctgtcaacaaaccctaagcttcaatttgctccttctttaatattcacattataccattcactcctgttgagcttagcaatcaactaaaagcacccaagtcttttgcataagccccaaatttaccttctgtgtttgtaccgtcttcactctctcaggagtcagagcgctcatttggccccaccccaattctccaaagctaaatcccacagatggaagcatatctgttatagagacaccgctggaatagtctccctaccctcccacccactaaaaaacagaaacgaagtctttgtctcaatacatggtctcttatccttaccctttccttgaatggggcttcattttaaagtgtgtctgggggaaggactggaagaaaacgcagtttcacaggccatctccaaaatctgacctaaaagccaactgttgcctggcctcaataaagcctgagcagtgtggtgccctgatctctttccttctccattcctcccccaagtgggctccaactggaggttgtggagatgagtgctgctgggctctgctcactcagtccctttgcctttgtgtgagtagtgacagatgaggctgagaaggaaaacgtggcagggtgagaataaacctgatattgttcaaagcatctgacatcaaacatatctctcaagaagacctactggaatccctctagccacacgaacaaggaaacgacagagaaccatttctacagaaagttccaggcggcctccctgggtatttttaacatcaggactcggtggaggggagagtcattaagcaagggaaaccccgtaaaacagaacatgtgaaaatgaccaagagaggtgggctgggaaccaggcagggcgaggctacagaaaagggaagctgtcacgggaccctggtggtgaggggcgacctctctctccctaagggcgctgggggaggggagggaggaggaccaccaagtctggagcgcggcgagaaggaaacagcccacctacctcgtccaggtctgctccattttccaggctctttccttagtctcaggacgctcctcacccgggaggggaagcagcctgggaaaatgagaagccttgcccacgaatctccagcgcaaaaggcagcagctttttcctccccagctcctttctgcgtcggcggcgaagagagagctctgctccctgcttttttagaaaatggatttgacgtggccgaacctgcggctagccgtgcgacccgcacaagggagggactgttctcagtaggaggctggactcagagcggcgcggcgcccggggctgtttcgtgagctggagccagcggctgcccgggcggcggtgcgcgcactctccaggctgagacacgactggctggcacgagttgctcggcaccagctgagctgtcaaccgcgagcggaggcggggctcccgacaaccagtgtgctggggcagaatcggcccaggttacacgccccctgaaccaccctcgcgtctccccgacccctctctcgctggctcagatgaatgatgacggcagagggcagagagcttagaggacgcggtaccaagccccgtccctcgcccatcccaacgaaggtcttagaatacaatcaaccaactacaggaagaatttgtagaggaggttttcttgtgtgtctgcatcgccccacccacaggtaaccccagagccagagatggagtctaggaaggtttaggagcaatcccggctgaatgcagatgtataccctacgtggtcatggaacacgatgttgtcttcctagagatgtgacatgccagtttcaccattaatccagggacaggacccttcatcaggaagggaagcatcccaacaaaaccttacagccctattagctgcctgtatcccagacatctcctgttttagggtattctacctcctcgtttttcagtttcgccagcaactgggctctaccaatagcttcaaggagggagaagcttcctgactcccagaacactagaaaagcctcaagacagtagccatcaggacctcgacactcccttgtgactgttttaagatcatggaaaaggcctctttggagatggcattgcctcaggccctgtaccatgtacttatgtatcaagatttaaacaaggcagacatactataattagagtgcttgccaccctgaagctcctttttagctttcaaataagaccgttttattaaatgacataatcactgttattattagcactatcactgaccttttttttatctgaaaaaggctttatagtgcccacatgtggcaatgttaatttcgttgtacttgtttcagagatgataaatttgagaccccaaaaggcccaaagtctctgctaaggttctgatacaggctgtgttctccattgggtggccccagagatatgttccctgaatttctaaagctacgacccacaagacttctccaggatgaatttattctttcaggcctcctaggcatttaactcaggaagaacctggcatgcctgggtattggtgagactgtggggagtctgtgttcttgggggaacctgtcatctgtctgttatctcttggattggttcccctacatactagtacaaagtaggggtggggaggggaggataacaaaacatttgaaggtttagcagaactgtctaaaaagcccctagtctagactcctccaacacttgatttattggtaggaccacactgctccagagctcaaaatgttaccaggaaaaatttcaaggtccagtttgatcttagacaaggctcacaggccacctgtcttgaaaagaatatcctgttgcctctgatgggggggaagaaaaggcagggagagtcagattcccatccttcataccaaagttggggctatatttagctttgtctcaaatcaaattatgggctaccgagttgtggagaggaactctgtctacaggcagctcactggattcaagaaatgatagcactaactaggtgagctgtggggtctcagaagtgacgctagaaaatacgttcatgtatttttaaaataacttttttcaaaagtttatagcacattcattgtaaaaacatttgaaaaatacagaaagttatatagattactcagaatacccagggatcttcaatattaaaaatgtgttgcatttttttcccactctttaaaaaatgcatcttttaatccaaacaccaactctttcttacacacatgggtatattcttgagaagagaaatttccttgttgttttaaaaattatacttattgtcaaaagaacaatttttttgcgttagatttcagaagaaaaatattcacccatataaccactgctacagcacaaatgtttaaatttctccaaattccctttagtcattatctatatatattaaatatctatttacataattacgattacagcttaggtatatgtttatattctccttctttcacttagtaaatatttgtccatgcttttagggaaagttcatagttattattctaatgagtgtacaatattttataatattagtaggaccatagattacttaaaatattctactattgcatagttatgctgtttctgatattagactgttataaataatgccttaatgaagagctttctgcctttatcattctccttttttgaattatgctatggttgaatgtatgtatgccttcaaaattcatacattggtacttaacaccgagtgttatagtactacagggtggggccttttaggaatatgtcttaggaagtgataaggcatgaacactccactctcatgaatgggattagtgctcttaaaaaagaggttgaaaggattgctctggtcccttttgtcctctgtccctccagccatgtgaggacacagcatctgtggcaacaaggagccatcttgggagcagagagcaagctcttccagacactgaatctgccagcaccttgatcttggtccagccttcagaactgtgagaaataaatttctattatttacaaattacccagtctaagctattttgctatagcagcaggaatggactaaaggcgattttcctgggataaaaggactttctaattttattatcttagcctcaaaagcactagaaattctccttttattttttttcttatttaatttgtaaataattggatagttatattttagttctatatctagctagtatacaaataatgtaacaccatctcattttgctttacgtttcttagaatactagctagtaaggtcttatttcatatcctttcttggaaaccacatgtgtagtagccagtctcatgaaatccttgtgttgagtcactgtattagtcatctttttgctgaaacaatgctgctcaacaaagaactccccaatctcagtattatacaacacacatccatttctccctcaaggatctatagtttaggtatggattggtttaagtctgtcattttcatggcagagtgcaggagtgcaagagagttggcagagactcatgatgactggtctctgctcagaactggcacagtctcgcttctgccattttccgttcaccaaagtaagtaacatggccaagtccaaagtcattggtgcagaaaagtacagtctgcccacagagtgcaggaggggagagtaatatttgtggaacaataatgcaatccaccagtcactgtatgtgctgctttcttgctttttgttaagcttttctccttgtagatacatggtaactttattcttcctcatcccattttaacttagctatgacttttgaacagtgaaatgtaacttgtttcgttggctgaaacgtgagaggaagtctcatgtggtcacttctgggaagaacgcagacatttttaagagctagtacataattggcccttttcagtttccgctgttttattgatccttgaagatcaataagatgaagctttcatcaacctaagtccctgagttactgtgatggtcagagccttcctgctaaccctaattgaacatgtagaatgagcaagaaattcatttttgttgtattaagttactgagatttggagattatttattactggagcataatctagcctatcctaacacattgctttttatttccattttgcaaccaagtatcgttatgtgtgtgtctgctctcagttttctggcttagaactcaaataaccggccgggcgcggtggctcacgcctgtaatcccagcactttgggaggccgaggcgggcggatcacgaggtcagcagatcgagaccatcctggctaacacggtgaaaccccgtctctactaaaaatacaaaaaattagccgggcgaggtggcgggcgcctatagtcccaactacacgggaggttgaggcaggagaatggcgtgaacctgggaggcggagcctgcagcgagccgagatcgcgccactgcactccaacctgggcgacagcgagattccgtctcaaaaaaaaaaataaataaaaagaactcaaataacctgggtaaatgatgttgataaattaaactattcattttattctttcctgagggcactgctcttagtttggtcaactgattgtgcttcagggaatacctgaattgatgataagggacaaaaaatcggaaggtgtcacagtctttacagtcagctccaaatattccaatgatacttttacctttcattcagtttttaaaattcattttccttttcttctctccaacttgtttctgggtaaaaaggattattgatgttgatatagtttactgcataatctatacatcaataataaaaatagctatgtctaatatatttttgccagatcctcctctaacaattgtgtgtatactaactcttttcatcctcgcagcagtcttttgaggtaggctctagttaatgcccactttacaaatgactaatgtggagcacagggaggtaaattatactgcccacattcacaaagctgattgatggcaaagctgagatttgaaaccaatcagttttgtttcagaatggcctgcctaaccattttgcgtactgcttccctaattttgacacgtaacattggctgggacttagataggaggacaatatgtctgcaacatctgtcacttcagtgatccctgtgatcacctggttagtcagaacatgatgtcttcttgatccatcacagctccatgtctgtctctctaaccttgggcttaaaaaacaaatgccctttccagacaaagaggcatcattctgagatcaaggatacagtgtctgtagtagattaaagatgaccacaaattacttgctacttctcccattgagaggtggaatctaattctcctccctttaatatgggctacccttagagacttacttgactaatagaatacagcagaagagatgtctgactggccaggctaggtaagtaagaagccttgtagcttccatgtgagactcttgggacatgtcttctaaggcctaagctgctggataagtcaaactaccatgctagataaaccacgtgcagaggccatgagaccacatgacaaggggaggggcctagctgagcacaacgaccagcagttcccatcagggtgccaggcattatgtgtgaagcagtctcccatcagctggacacaactgagcaaccctaactgtggccactatggaataaatttgccctgctgaaccatgctagaattattgattaccaaaatgatgagatacaataaattgcttattgtgctaagttttggagtagtttactaagtaacaatagataactggaactaaatttggtatctgaaagtggactttcactataacgaaaactgaaaacaaatggcaatgactttgtacctggttgccacagaagttagaaaggcctcgagaaaaatgttagtgaatattggaaggacatcgaggagactgctggagagactgaaggacagtaaagaaaatactatggggggtggctgaagaaatgacctgtgttatgtagtggcagaaagttttcgtctttgataatgtgggaaaatagaaaaggtgcccaatgaatgggaggatctggctaaggagattttcagcagaatttcaaaactacaaagaggtttcttttagccacattattataagatattgattaaaaaaaaaaagaaaaaaaagtgggctaaaaaaggagccatttggtttttaagcagaatttagaggaattataaagaggcaggacttgctgggttcagaagagatcgggtgcattcagggtggcatggccgtagactttgctgggttcaaacatcaaactgcttctcatcctcaatctctctagacagggaaagctttcaaaataagaaatggcttcagggcaaaaataaattccaagatgtgacagctagacccatgattaagacctcaattaaggtggtgcctcatatatcctttcagttaaacaaaaagccttctacaatcttgggcaatgtacctctccattggacaaaagagtttctaagaattttaaggttctgttatcccatgtcagactcacagttagtccaagcaaggtgaaaaagctggcttcagaatgaaatgtgggtgtggcttttgcctagtaaagttcgttatcaattagtatataagacgccttaacatttttaagtgaattataccagcatggactgactgaaaaggatgaagagagtacaaagtgaaaagatgcctttggaccctcaacctgcctcagagaagcaggctgagaaagttacccagccaaaaacaaggattacttcttagggaaaaagaagaacggctcaaagaatggaaccaagagcccagaggactgatggatagccagagggaatcattcccaggagcaggactgggccctaatcaaggaactggtaatatgtactcagctagatttcaaaattgctgtggactactgaccgctgtatgcctgtgttctctgactcttcgaatgggagtgcctattatggttatcctatctctgtcccattgtttcttgggtgtgagagccccagtgacttcagatcaaggggaactatactcaaggagctgagtgccaggagcctcatcatcacctgaatttgagttagatggtgagaaagtggacttctaggctgatgcagtaaatgtcaggaaacttttgagggctttaggagagtgtgagtttattttgcttgtggtaataatgtctgtggccagaggaaaaggaatgtggtagattcaagatggctacaaattttttgctacttctcttattcagaggtagaatctaattcccctcccttggatctaagctggtcttcatgacttgcttgaccaatagaatgcagttctaggtcataaactcctgaacctgggcaataagaaaccttgcagtttccagtaggcctcttgatatactgagctgccatgaaagaaatctgactaccttgctggagctatagagaggagaggtcttgaggccaccagcagtcctcaaaggcatcaggcacacaatataagtgaagttacctgggacctccagagcagccctgccttccactgaataccagcaagtgacccagtcaatactgcatggggaaaacaaattgctcagctgagacctgtccaaattactgacccacaaaatcataagatacaataaaatggttgttttgagctactgaattgtggggtagattgtttatgcaggaatagacaactgagaccatgccttaaaatggacacagtatttttgatgcattatctcattcattcatccaataaataattactgtgaaccattatgtgtcaggcactactctttattctagagacacagtagtttaaaaaaaggccagcaaagaccctgttttcatggagcttacaatctactggtttagatagataataagtaaaggaataactacaatatgccagatggtgataagggcgataaagataagtgaagcatgtcaagggagcatcccagcaagacaaccctctttttatagaagagaaaacagagtcttagaaagattaaataataggcagtaagagaagcaagttcctaggtacaatgaaactggagtttcacttgatgaaacactgttcaatagaatttataaattcaaattgttgtttagcacaacagaggaacttaataggcagaagtgtggcttggatggatgttcctgactacccaggctgtccaagtaaactgttgtatatacaagaatgaaaagatctgaggtggagccaaggtggccaaataggaacagctccagtctagagctcccagcgtgagcgatgcagaagacgggtgatttctgccttgccaactgaggtactggggagtgtcagaaagtgggtacaggacagtgggtgcactgcacccagcatgagccaaaggagggtgaagcatcacctcacccgggaggcacaaggggtcagggaattccctttcctagtcaaagaaaggggtgacagacggcacctggaaaatcgggtcactgccaccctaatactgcacttttccaacagtcttagcaaacggcacaccaggagattatatcccgtgcatggctcgggggggtcctacgcccatagagcctccctcattgctggcacagcagactgagatcgaactgcaaggcggcagcgaggctgggggaggggcacctgccattgccgaggctggagtaggtaaacaaagcagcccggaagctcgaactgggtggagcccactgcagctcaaggaggcctgcctgcctctgtagactgcacctctgggggcagggaatagtcaaacaaaaggcagcagaatcctctgcagacttaaatgtccctgtctgacagctttgaagagagtagtggttctcccagcacacagcttgagatctgagaatggacagactgcctccttaggttggtccctgacccccaagtagcctaactgggaggcccccccccagtaggggcagacagacacctcacatggccgggaactcctctgagacaaaacttccagaggaacgatcagacagcaacatctgctgctcaccagtatctgctgttctgcagcctccgctgctgataccctggcaaacagggtctggagtgacctcaagcaaactccaacagacctgcagctgagggtcctgactgttagaaggaagactaacaaatagaaaggacatccacaccaaaaccccatctgtacatcgccatcatcaaagaccaaaggtagataaaaccacaaagatggggaaaaatagagcagaaaaactggaaactctaaaaatcagagtgcctttcctcctccaaaggaacgcagctcctccccagcaatggaacaaagctggatggagaatgactttgacaagttgagggaagaaggcttcagacaatcaaactactccgagctaaaggaggaagttcgaacccatggcaaagaagttaaaaaccttgaaaaaaaattagaccaatggctaactagaataaccaatacagagaagtccttaaaggacctgatggagctgaaaaccaaggcacgagaactacgtgacaaatgcacaagcctcagtagccgattcgatcaactggaagaaagggtatcagtgatggaagatgaaatgaatgaaatgaagcaagaagagaagtttaaagaaaaaagaataaaacgaaatgaacaaagccttcaagaaatatggggctatgtgaaaagaccaaatctacgtctgattggtgtacctgaaagtgacagggagaatggaaccaagttggaaaacactcggcaggataataaccaggagaacctccccaatctagcaaggcaggccaacattcaaattcaggaaatacagagaatgccacaaagatactccttgagaagagcaactccaagacaaataattgtcagattcaccgaagttgaaatgaaggaaaaaatgttaagggcagccagagagaaaggtcgggttaccctcaaagggaagcccatcagactaacagcggatctcttggcagaaactctacaagccagaagagagtgggggctaatattcaacattcttaaagaaaagaattttcaaccagaatttcatatccagccaaatgaagcttcataagtgaaggagaaataaaatactttacagacaagcaaatgcggagagattttgtcaccaccaggcctgccctaaaagagctcctgaaggaagcactaaacatggaaaggaacaaccggtaccagccactgcaaaaacatgccaaattgtaaagaccatcaaggctaggaagaaactgcagcaactaacaagcaaaataaccagctaacatcataatgacaggatcaaattcaaacataacaatattaaccttaaatgtaagcgggctaaatgctccaagtaaaagacacagaatggcaaattggataaagagtcaagacccatcagtgtgctgtattcaggaaacccatctcacatgcagagacacacataggctcaaaataaagcgatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagacgagctaactatcctaaatatatatgcacccaatacaggagcacccagattgataaagcaagtccttagagacctagaaagagacttagactcccacacattaataatgggagactttaacaccccactgtcaacagtagacagatcaacgagacagaaagtcaacaaggatatccaggaattgaactcacctctgcaccaagtggacctaatagacatctacagaactctccaccacaaatcaacagaatatacattcttctcagcaccacaccgcacttattccaaaattgaccacatagttggaagtaaagcactcctcagcaaatgtaaaagaacagaaattataataaactgtctctcagaccacagtgcaatcaaactagaactcaggattaagaaactcactcaaaaccgctcaactacatggaaactgaataacctgctcctgaatgactactgggtacataatgaaatgaagacagaaatgaagatgttctttgaaaccaacgagaacaaagacacaatgtaccagaatctctgggacacattcaaagcagtgtgtagaggaaaatttatagcactaaatgcccacaagagaaagcaggaaagatctaaaactgacaccctaacatcacaattaaaagaactagagaagcaagagcaaacacattcaaaagctagcagaaggcaagaaataactaagatcagagcagaactgaaggaaatagagacacaaaaaacccttcaaaaaatcaatgaatccaggagctggttttttgaaaagatcaacaaaattgatagaccgctagcaagactaatacagaagaaaagagagaagaatcaaatagatgcaataaaaaatgataaaggggatatcaccaccgatcccacagaaatacaaactaacatcagagaatactataaacacctctacgcaaataaactagaaaatctagaagaaatggataaattcctcgacacatgaaccctcccaagactaaaccaggaagaagttgaatctctgaatataccaataacaggctctgaaattgaggcaataattaacagcttaccaaccaaaaaaagtccaggaacagatggattcacagccgaattctatcagaggtacaaggaagagctggtaccattccttctgaaactattccgatcaatagaaaaagagggaatcctctctaacttattttatgaggccagcatcatcctgataccaaagcctggcagagatacaagaaaaaaaagagaattttagaccaatatccctgatgaacatcgatgcaaaaatcctcaataaaatactggcaaaccgaatccagcagcacatcaaaaagcttatccaccatgatcaagtgggcttcatccctgggatgcaaaggctggttcaacatatgcaaatcaataaacgtaatcagcatataaacagaaccagtgacaaaaaccatatgattatctcaatagatgcagaaaggcctttgacaaaattcaacaacgcttcatgctaaaaactatcaataaattagttatggatgagacatatctcaaaataataagagctatctatgacaaacccacaggcaatatcatactgaatgggcaaaaactggaagcattctctttgaaaactggcacaagacagggatgccctctctcaccactcctattcaacatagtgttggaagctctggccagggcaatcaggcaggagaaggaaataaagggcatttaattaggaaaagaggaagtcaaattgtccctgtttgcagatgacatgattgtatagctagaaaaccccatcatctcagcccaaaatctccttaagctgattggcaacttcagcaaagtctcatgatacaaaatcaatgtgcaaaaatcacaagcattcttatacaccagtaaaagacaaacagccaaatcatgagtgaactcccattcacaattgcttcaaagagaataaaatacctaggaatccaacttacaagggatgtgaaggacctcttcaaggagaactgcaaaccactgctcaatgaaataaaagaggatacaaagaaatggaagaacattccatgctcatggacaggaagaatcaatatcgtgaaaatggccatgctgcccaaggtaatttatagattcaatgccatccccatcaagctaccaatgactttcttcacagaattggaaaaaactactttaaagttcatatggaaccaaaaaagaacccgcattgccaagtcaatcctaagccaaaagaacaaagctggaggcatcacgctacctgacttcaaactatactacaaggctacagtaaccaaaacagcatggtactggtaccaaaacagagatttttggtaaacaaaacagaccaatggaacagaacagagccctcagaaataatgccacatatctataaccatctgatctttgacaaacctgataaaaacaagcaatggggaaatgattccctatttaatacacggtgctgggaaaactggctagccatatgtagaaagctgaaactagatcccttccttacaccttatacaagaactaattcgagatgtattaaagacttaaatgttagacctgaaaccataaaaaccctagaagaaaacctaggcaataccattcaggacataggcatgggcaaggacttcatgtctaaaacaccaaaagcaatggcaaggaaagccaaaattgacaaatgggatctaattaaactaaagagcttctgcacagcaaagaaaactaccatcagagtgaacaggccctacagaatgggagaaaatttttgcaatctacttatctgacaaagggctaatatccagaatctacaatgaactcaaacaaatttacaagaaaaaaacaaacaaccccatcaacaagtgggcgaaggatatgagcagacacttctcaaaagaagacatttatgcagccaacagacacaggaaaaaaggctcatcatcaccggccatcagagaaatgcaaatcaaaaccacaatgagataccatctcacaccagttagaatggcgatcattaaaaagtcaggaaaaaacaggtgctggagaggatgtggagaaataggaacacttttacattgttgggactgtaaactagttcaaccattgtggaagtcagtgtggtgattcctcagggatctagaactagaaataccatttgacccagcaatcccattactgggtatatacccaaaggattataaatcatgctgctataaagacacatgcacacgtatgtttattgagggactattcacaatagcaaagacttggaaccaagccaaatgtccatcaataatagactggattaagaaaatgtggcacatatacaccatggaatactaggcagccataaaaaatgataagttcatgtcctttgtagggacatggatgaagctggaaaccatcattctcagcaaactatcacaaggacaaaaaaaccaaataccgcatgttctcactcataggtgggaattgaacaatgagaacacatagacacaggaaggggaacatcacacactggggcctgtttggggtgggggggcgggggagggatagcattaggagatatacctaatgtaaataacgagttaatgggtgcagctcaccagcatggcacatgtatacatatgtaactaacctgcatgttgtgcacatgtaccctagaacttaaagtataaaaaaaaaaaaaaagaatgaaaagatctgcccttcagtagctggagtggaatggggcaggagggtttggaggaggatgtgtggctctgaagactatacatagtaggcaaagtgccagctgtgactcggaacaaccaaaatcaggaccaggagcagtttagaagagaaaataattcttggaaaaagcagaagtatttgtggggtacaggggaatttgtaagggacttaatttcctaagtgaacaggtaggagttcagaggcagctaatgctcatgggacttaattttatttccacagttggtaaaactcaaggacagtgtggttaccttcattcatttaattaaacaaacacagagcatgtgctaggcattgctaaaatctagtgtagaaatccagtgttaaaatctagtgtggaaagccaggcaagcattcatcaaaccataatacaaaccagatcgggtaaagtgctacaccaagcagaacatgaaggagggagtgattaattaaattccaccagaaaagtttttctaaagaaggtagcatctgagtagagtactgaagtatgctagcaatataaaattttatcatacattgggattgcaaaatacagtgcttttatttaaaattaaaaaatattattagcttgttttcatcattccacagtatacacatatatcaaaacattgtaccccataaatatatgcaattactatttgtcaattaaaaaattaacttaaaaacagtattgatgaaaacaattttatttttctctggtagaaggaaaaatattcccggtctcctgtgagtgagtgcctaaggtcccattcatctgaaagagcggtgcagcgcagctgaggttgctggcaggcattacaacagagcagttaagattactggctctacagtcagggacatgggttccaatcctcctcctctgtcaatttccaaccatgcaattttggacatgacttaaactctgtgctttagcttcctcatttgtaaaacaaggttaatgataataactacctaatagggccactgtaagaacaaaatgagctaatatatgaaaagtttttaattcattgtctagcacattttaagcattctataaatcatagctatttttcattaatgtttgcataccaggcaggactccaatactgtgtagaagtcatgaattttaatttcagttctgctccaaagtgctccctagggctaggccagtgacccagattttccatttctcatctttctgatttatcatgtgagaccaaagcattggcaaggaagctgaataagtggatttcctcacttgctggctggaggtctagggagcagaaaaggtggacatttcccccatcttgtatctgtcttgaggaagtgtgtgtgtgtgagtgtgtgtgtgtgtgtgtgtgtgtgtgtttatgcaggaatagacaactgggacaatgccttaaaatgtacacagtatttctgatgcattatctcattcattcgttcattcattcattcattcaataaataattactgtgaaccgtgtgtgtgtgtttattcagatccatccctttcaatggttagccttgtctgtcagccataacaaaaacctcaaacctcaaggaaagaaattacaaccaagccttcagacagctgatggtaatttactcacacaatcccctttatcctttcaacacccactatttatctgtatctgacgttgggagaggggaaatcatgcaagaaatatggtatgtaaatttctggaaagggggttggaatagtgagggaagacttgtgtgaattacatgaataattctccttgatttgaacatagatatcagttctcaaaaattgaagggactgatgttagggtcaataaatacatttctgggaccagaaacaatactggaataaattcataaatagctttcaaggcattcatgacaatcacaccatcactaaaatccgagtcattttccaggatggggcaagtagttccagtacaagtcaaaggagcatgtgtcaatcaatctagactgctttaaaaatccatagtgataacaataactaaatggaatgcatgatcctagttcagatcttggattggattctgaattagaaaaaaaatatattgctgccacgttcagtggctcatgcctataatttcaacacttcaggaggctgaggcaggaggatcacttaaggccaggagttcgaaaccagcctgtgcaacgtagcgagatcttgtctctacaaaaaaaaatttaaaaattatctagggatggtagtgcaaaccactagttccagctactctggaggctgaggtgggaggatcacttgagcccaggagttgagcctacagtgaactgtaatcacaccactgcactccagcctgggtgacagtgagcaagaccctgtctcttaaaaaaaagaaaaaatacctctaaggacaagatagccatatatatccatggtccttgcctttgtttcttgtatcatgccatctactagctggtccctgaagccatatataataactttcactcatacacacatatgagtgaaaagtaacactgatttttttaactttccagcttgaaaaatttaaaattttcaacatatagtaaagttgtaaaactagcacaataaagtcctgtaaatctttcaattgcttcatagattgttaacattttgccacatttgttttctctctttacacacacacacacacacacacacaagcacacagacacaatcattagtattattttgatgaaccatttgagagtaagatgtagattcttcacccctaaatatttaatgtgtatctcctaagaatatttaaaatcgttgcataactgtattatgtaaaagaatataacacccttggccgggcatggtggctcacgcctataatcccagcactttgggaggccaaggcggggggatcacaaggtcaggagatcgagaccatcctggctaacacggtgaaaccccatctctactaaaaatacaaaaaattagctggacgtggtggcgggtgcctgtggtcccagctactcgggaggctgagacaggagaatggcgtgaatccgggaggcagagcttgcagtgagctgagatcgtcccattgcactccagcctgggtgacagagtgagactctgtctcaaaaaaaaaaaaaaaaaaaaaaaaaaaagaatataacacccttttcaggtcagcttttatcactattaagcagaacactttacatcataatctgaagtctcagcagtgaattacttaactaaaatcaggagctaccctctgctagatatttggctcacatctgtacaaccaaaagtgctgatcaaaataatcactcccaggacaaaggcaaaatatacaacaaagacaaattccctcttctatgcaccagccaatttcttggcagtttagaacagctgttttgtcctttcttccagctggcaaaggttcaaaaatatcaagatacagcctcagaaagcttcacacgaggaagaaattttaatgagaaaaatctcacgttctgtattcgcttttgttttcatttttattttagcatataaaatgtcaaaatactgagctgttgagtaccgtatcaaacatctggcaattctggacaaaagatgagcaaaactcaacagtcctttatctttgcaaagttcaagtggctttaggagttaatgccataggggtagggtgccacgcctcatgcctgtaatcccagcactgtcggaggtgaggcaggcagatggcttgagcacagtagttcgagaccagcctgggcaacatgtgaaacccatctctacaaaaaatacaacaaaaattagccaggcgtgctggtgcacatctgtagtcccagctactcaggaggctgaggtaggaaagtggcttgagcctgggaggcagaggtcacagtgagtggagactgtgccactgcgctccagcctgggtgaaagagccagacgctgtctcaaaaaccaaaacaaaacattatatcagtttggtaaaagaacaagcacatccaacattaaccatcacaattcctttcgaccagaataatcttttattcagataaaagtatcccagttttaggctatgcgtgtgatataataataacagacagagaggtacagaaatacccaagctggcccaggctcagagcttgtggtatacagaagagaattattgcatcctttatttgctggcttcggtacattcttaggagatagagggagggaaaaaaaaatcaaaaccagaagggtctggtgctgatggaccagatcaattggttcaaactttgattcaactgttaaggtattcagggctggaactaggatgggaggagcaaggcactcacctgaggtgcgaagtttaaagcgtgccaaaatctcggtaatcaagataaatcatattttaatgcaatattttagaaaaatagtaatgcaaaaaaaatccgcaatgaacaaaatatcaaaactttaaataaagacaggatctgaccctgcattttcatgattcagggagtgtcttacttgcttcgtcctagtccaggcccaacttgttcatccccagatgatgtgccaaaagccacatctttaggtgtctcctctggtgctctctagtgctatgttctgctgaccttgttggcaacagctctctgtctgttatgaatggttggacatcaggtggcacctttaagataccacaaggtaaaagcaactctctgagccaaggccagctcttccaacctccttccaaacagtcttacgtctcaagggcaagtttctgtgatgtatagggcatcagggagagggtagaatggggtagaaaggggagataatgggagagggaaaaaagaacaggtgacctcatgagttggcactaatgtaactagagtgcaatttttcaagagtctatcttttttaagaaaaccttgagccccaactcttatttggaggcacctgctcactcacctccaaaaccaaatccacctcacctctattcttcttttcacattgtgtacgggtagttctggaaatcaaagtggccatgctgcttcctccatgcagcctgtagtgaattcaagtagtgtaggatacttcaaactggagcttctctactgtgaatagctgctcatccccaagtaccaaacctaattttgtgacaatgaaaaccatctgcaggtgccccctgctggtggtactatcctagagacttgccttcactgatgtattttgtttggtcaatggtccagaaagtcacagtcacagtcaccaacactattccctatgcccttacacctaagcaggttcacttatttatgctacccgccaggcacctgcaggtgtgtggcatttgcattttccttctatggcttcctagttcctcatggtgggaacctggggcccgacttcttgcctctcaaactattaatatgtctgcctcacagggccaggcacttctctagtcttgagtcacccatgtcattcttttaacctaccctcgggtaggacactggagccatagatgtgaaccttagcctttaaggcacgcaagaagacactgaagtccccagggccagtcactgccagcaatgtcttccagcggtggttgaagggatgactgaggcaagcagagtctgagtttgttattgttctgaggatatagacaaaaatctttaataaggcttacatagcttggcatagtcttcagcctcagctctggttatactcccccttcccttttgtgcttagtttgtactagtcttgttccagaagaagaaagggagaactaattctgctgctcctctggtgtccaggagctcaggtaatggatgcagactgtaataggcagtctctaagttggtccccagtgatccctggtcatcaaacccttgtgtaattccctcgccttgagtctgggatggatctagtactcatttgtaatgaatacagtggggcagcagtgatggaatgttgcttccgagattagattattttttaaaaagcaaaaacaactgtggcttccatttggagtatgcatgctctctttcttttagatcagttgtgctgtgggaactaagctaccatgttataagcagacctattgtgtggacaggaactaaagcctgccaaataccgtgtgcgtgagtctgaaaacggacctttcagcccctgtcgagtcttgagatgacagcagccccagctgagtgcttgactgcaacctcatgagagaacttgaggcaattctaaccagctaagctgctcccagatttctgaccctccaaaactgtgagtactaaatacttgcagttttcagccactgaggtgatttgctatgcagcaatagtaatagtaacaaacacacagacttctgaacctttccccaatccaaggtcattctgtggagttagagacccactctcccattcacaaagaagctattattctctctacagtaaagaaagacaaagaagtcagagcagttttttaacgctgcacatcaggaaactagatgtatgctgaaaatttgggagtgataagtaggacctttcccagtctgtagaatataccaccaaagcatgctcactcgagaatgtgcttttgattactaccaagcacacttttttttctttttgaagatatgtgcaaacaatgaaaacccttcttgctgaaattacaatatagccgtacattttggttgaaatgtttatttggagatttcaaagtcaaggttgatatagccaaaagataatacagattagactatcatggaaacaaaaagaatctaaaatttgatattgttcgtacactagggtcactgctcatgttaacatttccttcattgcatccactttctcggagctggtgttgtagggttagatgtgagtgtgaatgagcatgcgtacagtggacaaaatccccccattctgtaaatgcgtgtgcctattattctgggcagtgaacccagcctgctttaagtctttgttatttgaatagtgtcccagactctcctttgaaatgtgcggttcacctatttttattaaccttaatatggagctttctgatgcttttttgatagattcttggtcgtgcccaggtacacttcctttcgttttaaacaggtcatatatttctctgtgctggccttcaggtggtgtgccatataaattagaaagcaaattttcacaaggtcaaattttaatcatgcagcttagtatttttaaacagatgacattttcatacttggtatgctaacttgaagaccagaccatttttgcccaagttctaccaaaggttttcgttttatagtcttcatttgttttgttttggtttactttttaacaaaaagcaaacctaggaaaaaattttaaaaacatacaagatgcacaaaaacaattactctaatacacatgaaacagaaaatcaacacctgccaattaaacacaacttctaccatttcataactgtgtgatcttgtcaaattacttaacctctctataaaacgggatcacgatagcatctttctcacagaattatagtgaaaattaaataatattattcttatgaaatgtttaagatcgggcctagcatttatcatttactcgataaatattaatcatgtaattatatatgtaattatggtgataatgataatgttgctgccatgagatgtcaggtttcacaatataaaatcattacagaattctgtttggaactcctgtgagacctagtatgaatcacctatagttatgaggctgctctagcaaataaatctaagagaacaggcaacttcatgaagaggttaaagtgtcctagggcagtggtctccaacctttttggtaccaggaaccattttcaaggaagacaacttttccatggacagggtgggggatggatttggaatgatcatcaggtattagatcctcgtaagaagcaggcaacctagatccctcatatgcccagttcacaatagggttcccgttcctatgagaattgaatgcagctgctggtctgctgatcgacaggaggtggagctcaggggtaatgctcgctggcctgccactcacctcctgctatgcagccggggtcctaacaggccagaaccagtaccagtccatgctctgggggctggggacccctgttctagggaaataccatcaccatgtctgctacccctcccaccgtgggcgctaccaccatttggtcaccatatgcaaccctgtgtgaagatattcttaatactatccagggtccttttcatttgagtgacctctatctctttgtcccaccatctaactcccaccctcataatgagtggggagaaaacctccaccagggtgaagcaaaaaacctcaaacagaggcttcaaacaaaacttaatataaagactccaaccatgaagttgtctctttttatcccccggttatcttctttgttggttttgttttcgggatctgcagggtaccaagttatctgctagaaggctcagtccttctcttcttaccagccccactgctaccgccatgatgtaaatcgctatgatctcacattggtgttacttactgcaatagccagcaaagcagctcccttccttccactcttggcctcctaaggtctgttttccaatagcaaagtgactttttaacatttttcagatcatatgatgttcctgttttaaatcttcattggcttccccatgtccttagaataacatccacttcttaccacggcctatgaggtctcaggtgacctggctcaggttcacctctgccccctcctcttatttattatgctccagctgcactggccattttcttcctcaaacacactaagcttatttctaccttaggggttttgcagttctttcacctcctgctttaattcctctctaacgaaatttttttaaaataaactttattaatatcagaaatccctttatttgtatatttatttatttgttttctgtctacgtcctcactgagcctttatccaataattttgttcctcattttattctagcacctagtattgtgcctgccattccatatataccttttggaaagatcagtgaacagactccagctattttttaaaataggatttactggaagaggagacccacagaatcaaaggaacagttgaagactcaaaagaacaggctcagaaggggcaggaatagggaggggcaggaacaggggaagcaattaggatctaggtagcaagaaggggccgattggttctggccactttttgctactcttatgttgttccactgatgatgcaatgctcaaaaaatcagatcattgggaggccgaggcgggcggatcacgaggtcaggagatcgagaccatcctggctaacacggtgaaaccccgtctctactgaaaatacgaaaaattagccgggcgaggtattgggtgcctgtaatcccagttactctggaggctgaggcaagacaatggcgtgaaccccagggggcggagcctgcagtgagccgagatcgccccactgcactccagcctgggcaacagcgagactccgcctcaaaaataaataaataaataaataaataaataaataaataaataatcagatcatcctcgtgtgggtctcaagattatcatttagctcgggataccttaaacaaacttcccaccaagactataaaccatggcaaagaagacaattctagccaccccccccccaaaaaaaaagtagggttattgtccaaagaagggaggaatggacacacccacagtcaaaaacccaaaacaaaacaaaagtctgcaataatctctgacttgacattttgtcatctagaagacaactactttctttctttttttttttttttttttttttttttgagatggagtttccaggctggagtgcagtggcgcgatctggctcactgcaacctacgcctcctgggttcaagtgattctcctgcctcagcctcctgagtagctgggattacaggcgcctgccaccacgcccggctaattttttgtatttttagtagagagggggtttcaccattttggccaggctggtctcaaactcctgacttcaggtgatctgccccgctaggcctcccaaagtgctgggattacaggcgtgagcaaccgcgcacggccaacatctactttcttgcagtattaactgatgtttgtttaagagatataaacagatttcggccgagctcagtggctcacacctgtaatcccagcactttgggaggccgaggcgggcggatcatgaggtcaggagatggagaccatcctggttaacacggtgaaaccccatctctactaaaaaatacaaaaaattagccgggtgtggtggcgggcacctgtagtctcagctattcgggaggctgaggcaggagagtggcgtgaacccaggaggcggagcttgcagtgagccagatcgcgccgctgcacgccagcctgggaaacagagcaggactccgcctcaaaaaaaaaaaaaaaaaaaaaaaaagatataaacagatttcaatattaagtcaaataaaagaagaaagataaatctgttcaaaattatacagcatactaaaaagatatgcttttaaatgtcttctctgtcctatgattcagaataaactagaggtcaggagacagttccatgagatatccttttggatatcccaaactaaattaattctctcctttccctgacatctgcttctcataccatattatctatctcagttaatgaaattactatttactctctgactggcctaggaatttgtttagacagagtttacttgtctagagtaataaactggagaataacatttgtttccaccatctccctcatttcccacactcaattaatcaaaaaatcctatcagttctaactcaaattctccaacctatctcttcctcgccattcccaataccaatgcctgtgttcaggcccttattacctttggccgtgaaccacttgcaacagtttctcagtgatcttcactcaatccacttaagcccatctctcacacgattgccacacttacaactctaaaacaaagatctatgtctgccagactcttctttaaaagcttctataattccacactgtctacaaaaataaaagccaaccgcctctgtgtcttagctgaaatgacagaatacaaaagtttctcagaatgatttataaatgcaaccttttctttaatatggaggttctttaaccctggtatacatgagaaaacttgtagtgcatttaaagaacactgatgctaagacctcaatctgaaaaagtctgatttaattggtctggaatgaagccttacatcagctttttaaagacctcccccaaataattctaatatgtagtcagggttgaaaactactaatttataacgtggctagaaagacacttctacttccagacagcatgcggtaatagggttggtattcattccccttcacccctgacagaaattactaaaaaataggacaagatatataaaataattattttcagacactggatgtcagacaacataggaaagttatccaagagaagagagaaacaagcaaagtaagccatacaactgtcctacttaactgccccagagctcacagagagggaatccaggcagagcctggtgatctgcctgagttgaagagatcatgcagagatttgagaaggccaaggcaggtagagttcatggggaagagtaccagaaagaatagaaaattccagagatctgtggagagtctccttgaatattcagctgaatactgatcggtatatcaggaaactaccaaggttggggtaagaaccacacaagagaatcagattaaacaatcctcttggctcatacaaggctggaagtagtttgtttcatcatctactaaagtgggaaaagcctcataattaacaggatattggctagagtacttagaagggtatcacccaagtaatggggaaaattaatcatctttaaaaagttgcttgggttccccataatgaagcttaagatcaagaaggatctgtttccaactaacttaactgtgacccagaataaagctcaataatgtttatgggaatgcaaaactatctaacacccaatatgtaaaatgtttaatgtgtggtatcaaatcaaagtattgccaggtgtgcaaagaagcaggaaacagtacttaaaatgaagagaaaaatcaattaccagaaacatactcagaactgaacaaatgttagaattgttattatagtattttaaatgttcaagaaagtagaacaaagattgataaaatgaagtaaaatattaatacatgggcggggcacagtgcctcacgcctgtaatcccagcactttgggaggaggcgggcagatcacctgaggtcagaagtttgagaccaccctggccaacatggtgaaaccccatctctaataaaaatacaaaaattagccaggcgtggtggtgggtgcctgtaatcccagctactcaggaggctgagacaggagaattgcttgtacccgggaggcagagattgcaggttgcaaggagctgagaccgtaacattgacaagagtgaaactccatctcaaaaaaaaagaaaaaaaattaatacatgaaagttacaaacttctagagatgaaaaagacaatatctgagatgaagaatacactggatggaattaacaacagattagacactgtagaagaaaaagttagtgaacttaaagacatagcaatgaaaatgatccaaaaataaaacaagagaaagaagacaaaaagtgaacagagcatcagtgatcaatgggaaaaatttaaatgacctaatatatatgtaactgaagtccctaaaggaacggagttatagagggcaacaaaaatttttgaaaaaataatggctgaaaattgtccaagtataatgaaaactgtaaacacacagatccggtaagcgtaacaaatccaaagcacgagaaacatgaaagtaaccacacctaggcacattttaatcaaattgcttaagatcagtgataaagagaaaaatttataagtattcaggagaaaaaagaacattatatagagagaaacaaggataagaatgagagcataacttgaaaattaaaagacaacagagaagccaggcacagtgactcgtgcctgtaattccagcactttgggaggctgaggagggcagatcacctgaggtcagcagttcgagaccagcctgaccaacatggagaaaccccatctctactaaaaatacaaaattggctgggcatggtgacgtatgcctgtaatcccagctactcaggaggctgaggcaggagaatcacttgaacccgggaggtcgaggttgcggtgagccgagatggcatcattgcactctagcctgggcaacgagagcgaaactccatctcagaaaaaaaaaaaagacaacagagcaacatctttaaagagctgaaggaaaaaaagagcagtcacctggaattctacaaccagcagagtaggtttcttgtgcatacaacccgtgtagtcacacagggctttgcactcagaaggactggcttggtttaatgctctgttgttgatgacttgaaattcttaataatatttgaacagaggggtctacatttttattttgcattgagccccacaaagtatgtagtcagtcctgataaccagcaagaatatctttcaaacatgaaggtgaaataaagactttttcacatacaaaagctgaaagaattttcccaccagcaaatctgcacaagaataagaaggattaaagaaattctttcaggcagaaggaaaatgataccagatgaaaataatgaagaatattggaaatggtaaatatgtcagtaaatatgaaactttaaaaatatcttttacatcactaatcagtaaggaaatgcaaatcaaaaccacaatgatatttcactttatacccattaggatggcaattattttaaaaaacaaaaacagaaaatatcagtgttcatgaagatatggggaaactgaaacccttgtacactgttgatgggaatgtaaaatggtgcagctgctgtagagaacagtatggtcgttccaaaaaattaaatatagaattaccatatatgcaataatccctcttcttttgcaacccaaaagcattgaaaacagggacacaaagagacatctgtacatccatatctgttgcagcattattcacagtggcaaaaggtggaaacaattgaaatttccattaacagatgaatggattaataaaatgttgtataaacatacaatggaatatgatttggccttttaaaaggtacatcattataagcctgagcaacaaactgagaccccatctctacaaaaatatcaaaaaaattgcttgtaatcccagccatttgggaggccaatgtgggaggatcgattgagcccaggaggtcaaagctgcattgaaccatgattgtgccagtgcactccagcctgaatgatagagtaagactatctcacacacaaaaaagtacgtaattacaacacatgctacaacacggatgaccctaaaagagattatgccaagtgaaataggctggagacaaaacaacaaatatatgatcccacgtataaaaggtggctagagtagtcaaattcatagagccagaaagtagaatagtggttaccaggaggtaggggagggagaatgggtagctactgtttaatggatacagagtttcagttttggaaaaagagaaaattttggagatggatggtggtacttgttgcataataatgtgaatgtacttaatgcaactactgacctgtacacttaaaatggctaaactggtaaatttgtgggggaagaagagtttatttagttctttttttttttttttttttgagacagagtcttgctgtgtcaccaggctggagtgcagtggtgtgatcttggctcattgcaacctctgcctccctggttcaagcgattctcctgcctcagcctcccgagtagctgggattacaggcgcatgccaccacgcccagctaacttttgtatttttaacagagacagggtttcaccatgttggccaggatggtctctgtctcctgacctcgtgatctgcgtgcctcggcctccaaaagtgctgggattacaggcgtgagccactgtgactggactatttagttctatttattcatttatgcaatgatggtctcagcagtaggtaataaaatataaccttatatttaaaattcatttttcattttgaaaggtttggatctttgtctcttctttctactttactattttatttatttatttatttatttatttatttatttatttatttatttttaatggtggtggatctgagatctaccttactgttttaaatacttaactccgaccaaatagaagataaatacaaattgtattcccttacttttctctaaggccatgctggtacaactagaattggctctttagaatgtaggtatcatttatagtaagctggagatttgatcacagaatgatacatgtaagaatgtcatagcacaaaaaaatgcacagatatttttaaaaggacaaatttcaggacactttccatctgagttcataagaaagtcctcttgagtatccttcaaagttaaaaccctctccccttcagattaatgaaaatattaggatgcatagaacacaatgggcactggtgatatggcccatggtagctgaattagattgagtataaatgaagtcttcacataatagcaaagaggccaacagaagaaaggccagaaagccacttgaaactcatgtccatggaagaccaaatgaagttgatttaactgttcccttagaaagatattatcccattgcttagccctcaaagtgctcatactgctactttccttctttatatcaccagttctgggagcaaacctcctgaaagaatggaagtatagactgtaaatacaagactgtgggtacagcaaaggggctctgatgctctagttgtttgtgtctagatactgtcaaatgtcccttgtgatgcacaattgcccttagcggagaaccattaaccaaaataaatgaaataatatgtcatgttcatgcatcagaagacccaatgttgttaagatatcaattctctataagttgatctatagactcaatgtgaccccaatcaaataccccactggctttttgtctacatttacaagtgaattctgaaatgtatatggaaattcaaagaacctaacacaatgaaaacaattttgaacaagaagagcaaagctcaagaatttgactacgtgatttcaaaacgtataaagctactgtaaccaaatcagtttggtattagtctaaagatggataagggaggctgaggcagtagaattgcttgaacccaggaggcgaaggttgccgtgagccaagattgtgccactgcactccagcctgggcaacagagttagactccatctcaaaaaaagaaaaaggaaaaaaaaaaggcagataaataaatcagtcaaacacaatagaaacccagatacagacgattatatatgtggtcaattgatttgaacaaaggtgctaaggcaattaaatggaaaaaggatagtgctcttaacaaacagtgttagaacaactgtacatctacatgcaaaaaaaaaaaaaagataaaaaagaaaaaaaaaaacaccttgatcacaatatacaaaagttaactcaaatggatcataggcctaaatgtaaaaatgcaaaactataaaacttctagaaaaaaatagaatatttttgtaatctggattaagtaatgatttcttagatatgacattaaaagcagaaccataaaagaaaaaactgataatgtttatttaccacagcaaaattttaaaatgtctggtcttcaaaagacactgttactaaaatggaaagacaatctgcacagtgggagaaaatatttgcaaagaacatatataataaaacttgcatttagaatatgaaatgaacccaatgaactcagtgaaacccaaacaactcaatggaaaatgggcaaaatatttcaacagacactttaccaaaaatatgtagataataatcaagctcatgaaaaaaaagctcaatatcattaatcattagggaaatttaagtcaaaaaaccataagatttcacacccactagaatggctataatataaaagatgtacagtaacaagtattgagaaggatgtggagaaatgagaaccttcatacattgctagtgggaatgtaaaaggtacaacccttttggaaaacgatttggcagtttctttaaaagcatgcctagtgttatataccccgagaaatgtgcccaagagaaatgaaagacatgtgcacagataattatagcaactttatttgtaatagccataaaactggaaacaactcaacgaatggtgaatcaataacgtgtagcacattcatacaatgaaatactactcagcaacaaaaggaaatgagctactgatacccacaacagcatagataagtttcaaaataattatgctgagtgaaagaagccagacaacaacaaagagtagatactgtatgattccatttatatgaaattctaggaaatgcaaagtaatatataatgacaaaagcagaggggcgggaaggaggaatttaaaaagggcagaaggaacctttttgggatcatggataagttcgtcatcttgattgtggtgatgatttcacaggtatatacatacgttgaaacttcaaattgcacactttaaatttgcccagtttattgtatgtcagttatatctcaataaagctgtagaacagcaacaacaaagagatggctagacaagcatattacagtagttgaagtttgatgttagaaattcactgaatcttctctgaagtcattgtcctctgacagttgtctgcaggtttcaagctatccacctacacagaatgtgcaatctgctgggcttcaaaagcacacattgaggcagatggccaacagctgacaattcacttaatttctctttttaaatagttatatacttgaaaaaggatcgagtttgaattaaatcctcacagaaaatttctatcacagcatgggattcacttcaataaagcatcttcccactgtcataaatctgcttgtgttcttttggcaaaattttcttcccactcaacctggctttgttatcttgtcaagccagacaaaaattcacctcctgtataaagccgtctctgatcatctgcctttttaaattttttaattttttaatttttcttttttgagatggagtctcactctgccacccaggttggagtgcagtggtgcaatctcggctcactgcaacctccgcctccctggttcaagtgatcctccttcctcagccttctgagtagctgggatgacaggcgcaccaccacacccagctaattctttgtattttcattagtgatggagttttacaatgtcgaccagactgatctcaaactcccgacctcaagtgatccaccggccttggcctcccaaactgctgggattaacaggcatgagccaccgtgaccggcctcatctgccttttagcaccatagagaggtgccattaaccacctggtttatattgccagcatgtaggggctgtaatatggtaccccagccccacctccctaccccatcattattttttcttaaagaaaataagcttgccacttagaatttaaactttacaattaagataaactgatttagagaataaatgtagacacttgaaacagtcacaaggatccccaaaccagattataatctgactgaaaatattagcatatcagagatagaaaaagagatgtacctaagaagggaggacaatcatcagtggacacttactgtccaggaaaaaagaacctatgtgtacaccttgatgctctgaagctatcaaattatttgaaatttagaatccactaattaattcctcttgctctagattcaagtttcaaaaacaaccttttggctgtaatttggctctcaaatgtggcacatataccaagagatattttgctggaatcataaaagagagtctagttccctaagatgttaaaattctcattataaattagtaatttgttattctgggtttatatagtagtcctgtgatttatcagtttaagaaacagacttggctgggtgcagtggctcatgcctatagtctcagcactttgggagggtggggtggtaggattgcttgaagccaggagtttgagaccagcctaggcaacatagcaagactccatctctacacaaaataattttttaaaagtagccggaaatggtggtacacaactgtgatctcagctacttgggaggccaaggcaagaggatcccttgagcccaggagttggagactgcagggagctatgattgcaccacttcactccaacctaggcaacacagtgagactccatctctgaaaaaaaaaaaaaaagaaagaaagaaaaagaaaagaaacagacttaacaagttaaagaccagatttcaacatattttccaagataatgccactttctatggcctgttagggaagtcagctttccttggagaaatagagagagagagagagagagagagagaggtctacagttcatctttctgttacagcacttactccatactccagttactgaagcacattatagaactacagattctgagttacctgagggtagttttgtatccagtttgtgctggcctccaccatcattgctcaataagtaacactgaactgaactgaatttggataacgtgcaaagctgcttttttacattttttagttgattgagagttagaaaatcgtaccaaaaacaccactccccaagtataacctctaatacgctaacattcattaaacctctaacactatagctaaagttgttacattttttaaagtacgctaaactggggaattgatttttaaataaagggcaaagtagcactaacctcagtcaagttgctgtaagtgtttcatttgggaattgtgaaattttttaaaaacatttcaagacttatcattacatcaacgaagatgaatataggtgtagtttgtcagatgagtaactattaaggaaaccatgaatgtttgctatctactttcacaattaaaccacaatttagaggatcaaattctaaccctataaacttttttttaaccaaagacagggagaaaaatcatactcttgtgataaggagtcataattcattttaaattctgcaggattaatgctgctttccagataagaagaattcaccccgtgtgcgtaaggtgattaaggagccttggaattataaatacacattcagattaatttttttgttctaagctttaaataaaatttcaaagtattttataaaataattaacatcccatagatatgcttttttaaaaaagtaattaggtctataaaagtaatttgtataaggcaataaaaattttactttataaaaaaatcaaacaatgaatactttttgcttaattctttcttaggagcagtaatttattatgggttccttagaagacatgtgatttatttaagctctattaactgaatgtgagtctgttttctgacataaacagtggatagtgttatgaaaaaataaaattgtcagtgaataggctaaatttcatagttcacaaatatagctatcctgaacatagaatacagatccaatgaacatttagttttataattagcactgttttaatccaaattccaattttatgcatgggaaactgaggcctagagaaatgaagtaactttttacagacccgttagctcagaggctggaatcactaggcctggtagtttgatttatgagtactaccttccatgagataaaaagctaaaaatgctgtgatgaggacatgtttatttctaaaaagcctgcagcacaatctatctcttctcccaaaaatcgtatgtatgacagatttttatgttactgctgctacacgaagaaaattgagcctaatatgttcggtcttccaggccaaagcaaaggattgattttagaaggaacttgtcctgcatggcctccatccagccatcaggcagggctccagctctgcaggggaaaaagagatagcccaggaagagggaatcaccacccaccccaccctgcgatctgtatctaagagaaataaccctgaaaagaagagctataagagatggcagtgtgtgctttcgtccgggtgcacttcccgatccttcatctttcatgcccatctctgatgtttccatcctggtatagccttctgagtcatgtgttcatctctcctttggctcaacccaacagacacagcctgcaatctcacctccgtcaacacagcaaatgtctgtgtctcaaagacctcgagatagagcttcctatgctttaacccttccaggggcacacctttatttctgggcaactcaacactgtccctcctcctgcctccaccacgggccccattacctccctacccttctccaagcagtagtcactcagcgccaacccctctcaggcgtcgggatcttcagtccggggccccagccctccgcgcggttctcctgcccagcgcaccgtgcgttgccacccccatcgcgttcctcagcctcccgggctccagaggcaggagctggccatgctctcacctcatccagggtgtggccgccgcagctgcttcttcctcctcggccgctgctgcccagctcccggctggctccgggcgccgtctttcccggctcggggtctgccgtggggactgaggggttcgcgtcgcgtccccggaccggtaaggcgtgtagtgagcccggcgggacgcgcgacagcagcagccaaagtcgcatcggcggcggcagcaggacccgctgtctgtgcccttcatggatttcctgggcctggccaccccagtcctagctacggttcctgcttgttttcctggtgtcttccgggactgccagggcgcatcctctgggcctggctgagcatccccgtcagttccctgggcctcctccgcggctgcctctgccacctgctccgcccagattgctttggtccttctcccgcagacacactcagctgcccttcatcctctgtcgtctccccattctctctccacccactgcctcattcccagatcccacgccgtttcttcctttctatccgctccaatgtcaccttctctttatttccaacctcagataagtttctccttttctttctgtctctctcaatattttccccggtttcatcctcctccccgcgcccccgtatcagtcatccttttataatttatccagtttttcctctcctattagttcctcagaatcactactgcaggttgttggctagcctcttttcttcctctccctgtttctttctctttcctaaaatcttttcctttcaattttcccttgagtttttcaattgtaaaaactttctcccaaacaacctacattttcctttcagttgagactgattgcagttttccatgaactcatagtaaagcatatatagcttggtatccaccataaaccaagaaagtgttttaacctttttttaaagttggtcagttaaataaattatcccataaatattcattctgaaaatccagttcttatatcctacatatgtccttgaaaacagagactagtttgcttttgtatccagcaaagcaaaatgtttctgcaacactattgcatatagcataagttcagcaggggagggggagcaaggtttgtctttgtagttgggcactgtggatctcaaggttcataggcaacagctattattgttgactgactgaatgcagacaaagctgaattcatctcagctcatccttccaaatctgttgctcagttctgtgttttaaccccagccctatctacccagctgctcaatccccaaacctagaatttgtcagggacctatttctcttttacccatctcatccagtcattaattctacttttttactctctccctctctctctctctctatagatagatagatagatagatagatagatagatagatagatagatagatttttttttttgagacggattctcactctatcacccagcaggctggagtgcagtggcacgatcttggcctactgcaagctctgcctcctgggttcaagcgattctcctgcctcaatctcctgagcagctcggattacaggcacctgccaccacgcctggctaatttttgtatttttagtagagatggggtttcgccatgttggccaggctggtctcgaactgctgacctcaagtgatcctcccgtctcagcctcccaaattgctaggattacaggcgtgagccactcacctggcccattctttcttttaagcctcctaacttaagcttcatctttacctctccttatctttgtccaatctgtcttatctgggctctttgtctaacaacctctaccagaaaattcttaattatctcttattgttttgtatcttcttcctctccttttccattagcttcatccccagcccacaaacatgcttaactctcctcactcttaaaacaaagtccttccctctctacctatcaccatatctctcacttcccttcacatccaatttgtttaatatattgtgttcatttgatgtccacactttctgacttcccaatcattctttacctcctaattttctgcaatcaggcttctaatcctattgcttaactagaggtattctcccagaggtcctggcgaatttcatgtcaggcataggtaggcaatgccagatcagttgcccctagtttttctccccgcaacaaacgaattcagatctaagaaaaaaaaaaaaaaaaaacctgtggtatcaaggccaccacattgcagagcactcaaccgccatttaacctacataaatagcaccttacccactgaagcctgcacaactaaaaacaatggccttgagtggtagggctaaactcttgggttcatgcggtttatccaaatgcaggctgaagaggaatccccattatatgactctagattgataaattacctagttttgattatggccttagattttagagattcagactttggttttgcccatagacacgtggtagattttatctaacacacaaattaaaaggaatagggctccataacttaaagagaataagccatcttttgtagttgtggcagataaacagttcagtgaagttactgcaaacccacagcattcattactgctatgaagtactgagacctccaactccagccaagatgtagtagtatatatcaaactaaacctcccacttcagggggaaagtgggataaaatatacataaatatttacatatttgtatatatttatatgtgtgtgtgtatatatatatagtcatgcaatgcataaccaagttttgatcaaagacagactgcatatgcaactggtggtcatatgcagttgcatatgacttgctatacattttccaagtttagatgtacaaatacctaccattaggttaaaattgcccacaatatttagtacagtaccatgctgtacaggtttccagccaaggagcaataggctgggtgtgtagtaggctataccatctaggtttgtgtaaatatattctgaatgttcatacaacaataaaattgtctgatgatgcattactcagaatgtatccctgtcattaagtaatacatgactttatacatatacggatggtccccaacttacaatagtttgacttaaatttttttgcctttatgatggtgtgaaagtgataaacattcagtagaaactgtactttgaatacccatacaaccactctatttttcattttcactacagtattcaacaaattacataatcaacactttattgtaaaataggctttgcattagataattttgcccaactgtaggctaacataagtgttctgagcacatttaaggtaaggtaagttaagctatgatgtttggtaggttaggtgtattaagtgcatttttgacttacaatattttcaacttaggtttattgagatataaccccatcataagcctaggagtatctatatatctatatctataattctttggaggcattgaagagtaactaaaccaggcggaacttaaagctatgatcctggagagaaggcacatgaggtgaactcagtgtttaccctggaatatttctcttgagggaatgctcaaaactaagtgcaagacaataaaagccaaaaaaaaaatacagcagtttttctgggctgaggaataagaggctgtattagtctgttctcacactgccataaagaactacctgagattggataatttatgaagaaaagagatttaattgactcacagttcttcaggtttaacaggaagaatgactgggaggcctcaggaaacttacaagcatggtggaaggtgaaggggaagcaagcacgttttaccatggtggagcaggaaaaagagagtgaggcgggaagtgccacacactttgaaaccatcaggtctcatgagaactcactctcactatcatgagaacagcctgggggaaatctgcccccatgatccaatcacctaataccaggtctctcccccagcagtgggaattacaatacagcatgagatttgggtgggaacacagagccaaatcatatcaaaggccaaagttgagggctaccaaagtgcctctgattgagggcaaactccaagaggggagaattgcagaggagctcaacaatctatgcaaattgccatcatgatagtgatctaagttcctacactcagcatgcacaaagaaagatgccaaaaaaaaaaaaatcagaaaacagcagtttagggtctaatgaggtaagtgaagatttcagcatccaacagaagttggacttcaagccttgataaggtacctagatacccagggttttcagttgagatctcagcacatccttggagtaagagcaatataatactgaaataaaatagatctaacaaagcttgaaaccaagccttttcaggatcaaagttatctgccactattctttctactttccaggagtagaaagtagaaactctatggaggtaggtaacattatccagagtctacaattttgtcttatacaatatctgggatccaatacaaaataattatgagccatgcaaaagatcaaatccaaatgactaaacactaagagaaaaacgttaatagaaacagaactagatattagaattggccaggactttaaataactataattaatagttttaagaaaatagaagaaaaggtggacaaagatgaaagatgggtaatttacttcagtatagaattggaatctgtaaaaacaattattggacaaatattctaaaactaaaaattacaggccggacacggtggctcacgcctgtattcccagcactttgggagactgaggcaggcggatcatgagctcaggagttcgagaccagcctgaccaacatggtgaaatccccgtctctactaaaaatacaaaaattagctgggcgtggtggcatgcacctgtaatcccagctactcaggaagctgaagcaggataattgcttaaatctgggaggcagatgttgcagtgagccaagatcacaccactgcattccagcatgggcaacagacagagactctgtctcaaaaaaaaaaaaattacaataactggaaataagaaccctttgggtgtgcttaacaacagtctgagtacagcagaagtcaggattcatgaactggaagacaggtctgtagaaaatatccaaactgaaggacagagaaaaaggaaaagaacataacagacctcaaaaacacagtaaaaatgtctaataagtgattaattgcagtccctgaaagagagaggaaagagaggagcagtatttcaggagacaaagctcaagaattttctaaaactgataaaaggcatcgacctctcagatgccagaagttcagccaaccccaagaagaacaaaagaccattatcgctcagaaatattagaagcagtttcaatttagatatttgctgaagacaattcttaagttgaaactaaggaagaactcttgattgagaggcaggtttgataggtctaagcagttctacagcactagacagtggcatgagtcacggtggtatgggcttgaaatgtccacatagaaaagagtgtgaaaattgctgggcgcggtggctcacgcctgtaatcccagcacattgggaggccgaggcgggcggatcacgaggtcaggagatcgtgaccatcctggctaacacagtgaaaccccgtctctactaaaaatacaaaaaattagctgggcgtggtggtgggcgcctgtagtcctagctactcgggaggctgaggcaggagaatggagtgaacctgggaggtgtaggttgcagtgagctgagatctcgccactgcactccagcctgggtgacagagcgagattccgtctaaaaaaataaaataaaataaataaataaataaaaagaagagagtgtgaaaattatataataaacagaacccacactcaaatcagccctttagtgccagaaaaaaaagagggattcaaaagagaaatggaaattaatggattttgattatcctggtgggaaatcaaaaccaataatttcactaaaccatagtaactggaaactgaacctgccaacctgtaactttctaaatttagtaatgaagtaccaagatttcaagtgtcgctctctgagagaggagacctgttattaagtgatttccaacccccatttgccacatattaaacacagtatgattaacctcttcacagtaaacatttatctcaattgactttacggttataggtcacaggctcagataattggcatataatgtttgtcaaaccagataggctaacactaaaaggttccctcttctttgtctacttgagtttctgctatgagtttggaagcaactatgaatctgaattgttccaaatattgcactgggttctgataatatcattttgtttggttagctctaagactttgaaattgacattttaaaaagtagactttatttttttaaagcagttttaggttcaggacaaaattgaacagatgatagaggtttcatacatacatcttgcccccgagacacaaacagcctcccccgcatcaaaatccagagtgtacatttatacaatcaatgaacctacattgacacacattatcatccaaggtccatagtttacattcaggttcactcttggtgttgtacattctatggattttgacaaatataaaatggtatgtatccacagttatagtaacaaatagagtagtttcatggccatgtaaatcctccatgtgccacatgttcatccctccctctttccaacccctgacaaccactgatccttttactgtttccactgttttgccaattccatagtgtcatatagtcagaatgataccatatgcagccttttcagatgggcttctttcacttagtaatatgcatttaaggtacctccatgtctttgcatggcttgatagctcatttcttattagcactttataatattccattgtgtagatgtgtcacagtttgtttttccatttacctgctaaaagacattttggttgcttccaaattttggtcatcatgaaaaaagctgccataaacattcatgtgcagggttttgtgtgaatgtaaaatttcaactctggggaaataccaggaagccccagttgctggatggtaaagtaagagtatgtttagtttgtaagaaatactcgtcttccagtgtggctaccatttttgcattccccaccaataatgaataagaatttcgactgctctgcattcttgccagcatttggtgttggtgttggcctttctaataggtatgtggtagtacattattatcgtttttatttgcaattccccaatgatgtatgatgttgagtattttttcatatgcttatttgtcatttgtatattttcttttgcaaaatgtcttttggctatatttatgtgggtctctttctgcactctctactctgttccattgatctatatttctattattttgccaatgtcacactgtcttgtttactcacatagtgtcctccaactttgttcttctacttcaatattgtgttggctattctgagtatttgcttctgcatataaactttagaatcagtttataaaaatccacaaaataatttgctgggatttttattagaattgcattgaatatatgggtcaagttgggaagaatcgacatcttgacaatactgtcttcttatccatgaatatggaagagctctccatttattttgtttatttatttgtttattttgagacagggtctgactctgttacccaggttggagtgaagtggcaccatctcggcccactgcaaacctccacctcctgggttcaagcgattctcgtgcctcagcttcctgagtagcttggattacaggcacccgccaccacccccagctaatttttgtatttttagtagagacagggtttcaccatgttggccgggctggtctcaaactcctgacctcaagtgatccgcctgccttggccacccaaagtgctgggattacaggtgtgagtcaccgtccccagccagttctccatgtatttagcttgttttttattctttcatctgtttttttagtatagtcacagaattgtgcaatcattatcactgtgtcatttcagaacatttttatcaccctcaaaacaaactccatactcacttaccctttccatttctaccaccggctgttcctctccccagcccctggcaaccactaatctttttatatttataaatttacctattctggacacttcatatagatggaatcatctaacatgtagcacattatgtctggcttctttcagttagtatggtgttttgaggtccatccactttacagcgaatgccaatatttcactcacttttttattgctgaaaatatattatattgtaaggaaatatcacatttaatgtacctatttgtcagttgatagacacttaggtggtttttgtttgtttgttttttgctatagtgaataatgctgctgtgaacgctcatgtacatgtttttctttggacatatgttttcaattactttgggtacatacctacgagtggagttgctgggttatatggcaactctgtttaactttttttaaactgccaaagtgtttttacaaatggcctcataatgtttacattcccaccagtaactcaatgtttttccacattctaaccatttgttagtatgtgtcttctttattatagccatcctagtgggtgtgaagtgacatttcactgtggttttggtttgtatttccctagctaataatgttgagcatcttgtcttgtatttagtatttatttgtatatcttcattggagaaacattttttcaaatttgttgcctatttttcaattgggttgtttgttcttattttattactgagttgtaaggggtgtgtgtgtgtgtgtgtgtgtgtgtgtgtgtgtgtgtgtgtgtgtgttctggatgcaattcctttacctgatatgatttgcaagtattttgtcccactttgagggttgtcctctcactttcttgtgctttttgaagaaaataagttttaaattttggtgaagtctttttatctatttttttcttttgcagcttgtacttttggtgtcatagctaggaaaccatgctggatcaaaggtcacaaagatttattcctgtgtttcattcaaagagatatatagttttagctcataggttgacaatccattttgagataatttttatatatagtgtgatgtaagagcccatcatcattttgcatgtgaatatccagttgtcacacatcatttgttgaaaatactctcctttccttatttttttttaattagaccatatatgcatgtgtttatttttgggactctcaattatattccattgacctgtatgtctattctgatttcaataccacactgtcttaattatgttgcttgttattaagttttgaaatcagaagtatgagtccttctcacacctttttccttcttttaaagatggttttaattattctgggtcctttgcttttctacctgaattttaagagcagcttgtcaatttctgccacacacaaaaaaaaaaaaaaaaaaaaaaagagagagagagagatcctgctgggattttgatagagattgcaacaaatctatagatcaatttgggattactgccatcttaactctgttaagtcttccaatccatgaatgtggaacatgaacatggaattcctttccatttatttaggtcttttaatatttccttcaacaacattttgtggtttttagtgtacactttttttgttagatttattcctaaacatttcatttatttactcattttaaatttcaacttttagatacagagggtacatgtacagctttgttacatatccatggaggtttttctacccatgttccctccctcggtcccctctctagtagtccacagtgtctattgttcctatgtttatgttcatgtgtgctcagtggttagctcccacttataaatgagaacatgtggtatttggttgtctttttctgcattaatttgctaaggattttggcctccaactctatccatgttgctgtaaaggacattatttcactttttatggctgtatagtattctacagtgtatatgtaccacattttctttatccaattcacccttgatgtgcacctaggttgattccatgtatttgctattgtaaattgtgcagtgatgaacatataaatgcatgtgtcttttggtataatgatttattgtcctctggatatgtacccaatcatgggattgctgcatcaaatggtcgctttaagttatttgagaaatctccaaactacttttcacagcggctgaacaaatttacattccgaaaaacagtgtgtaagtgttccctattccctgcagccacatcagcatctgttgttttttgactttttaatgatagccatttttgactttttaataatagccattctaactggtgtggggtaatatctcattgtagttttgatttgtatttctctgataattagtgttgtggagcattttttcatatgttggttggtcacttatatgtcttctttaaaaaaagtgtctgttcatatcccttgaccatttttaaggggattatttgtttttgcttattgactgaagttccttataaattctaggtattagatctttgttggatgcattgttagtgaatattttctcccatccggtaggttatctatttaccctgttgattgtttattttgctatgcagaaggtctttagtttaattaggtcccatttgtcaatttttggttttgttgcaattgcttttgggcacttatccaaaaactttttgccaaggctgatgttggtaaaagtatcttctaggttttcttctaagatttttatattttgaggtcttacatttaaatttttaattatcttgagttaatttttgtatacagtgaaaggtaagggtctagtttcattcttctgtatatggctagccagttatcccagcacaatttattgaatagggagtcctttccccattgcttgtttttgtcagctttgttgaagatcagatggtgtagatgtgcagctttattttgatgccttgtaaatggaattgtgctctcagtttcatttttggattgttcatttctggtgcatagaactgcaaatttttttgtatattgatcttgtaccctacaatttggtgaattcatttattaattcttaaatttttgtgtggattccttagaattttctatatacaagataaagtcatctacaaatagaaatagtgttacttattcctttccagctggggtgcttttatttctttttcttgcctaattgccctcattagaacatcaggtactatgttgactagaagtggtgagagcggacatacttgttttattcctcatcttacaggaaatgttttcaagtctttcccctttaagtatggggttagctgtgggtttttcatagataccctttatcaggttgaagaagttctcttctttcctagtttgttcattgttttttaacaagataagatgctagattttctcaaatgctttttctgcatttattgagatgatcatatggagtttgtcctttgtcctttgtaatatggtgcattacatttattgtttcatatgttgaatcaaccttgcattcctaggataaatgccactttgtcatgatgtataatctttttcatatgttgccaaataaagtttgttgagaacttttacatctatatttataaaggtatactggcctgtcattttcctttcttgaagtcttagttttggtgccagggtaatactggcctcatagaatgagatgggaagtgttcttcttctcctttttttcagggggtgaagagtctgtgtcctataaacatattcggcagaagtcacagattaagctatctgaacctgggctcctctttgtggaacattaaaaaaaattattactactaattgaattgctttacttgttatagggtattcagattttctattgcttcctgaatcagtttgggtagcttgtttctttcttgaaatttgttcatttcatctagtttatctaatttcctggcatataacttctcataatattcctctataatattttgtattccacaggttggtaataatgtcccctctttcatttctgatttgatccatgtgttttaaggaaaagtttgtgtccccacgagtatccctccataaaaaacaaaacctccagaaaattctgtctgagactaatttcaacagttacaacgttacaacaaagacaaatttaaaacaaaatgcctctggtgtaatttgtggtaaatgatagcttgtgttcagactagacttatcatcactgctcaaaaaatgtcctttaaaaattatgcaaattttgatacatcacccatcatccattacttctattttccaaagtcttgaagtattttagaagttcaattaaggcttatctcgtatcagtattttcaagttttctcagcagcaattcatagagcatattgaacgaaattaagcagccacacaaaacctgtccaaaatccaaacacaagtgtagcaattttagataaggttttgtcatttgtggcaaataaaatgataaataccaataaaaatgcacatcctatcccacaagtaatataaaaatctagtatttcttttggtgtggcaactgcaataaactggagtacacaaacacagtcagaataaggaaattcataagaaaggcactgtgtcacatgaaattcacataagtgaggtcctccacaaaaagtgtattacagggacaaacccttttcccagctaaaggctgggagagagagaacagctggaagtctctgagatcaccaccgccactggagctggccaagggacacaaaggtactaagatcatttctgctctctggtaggaggtgggtcctcctttgtgttggactgcaccctgttcccttcttcactgagaatctgagaagtcttgtggtgatagctgaacacttaagatgccagcctcagagtaggtcattctggtttgccctatgccatgtggtaagaagccagtcagcctgcccatttgagaaaggcctgctgtttctggagtgaagtctgcctaattctggagtgaaatattagcaggacctttgcatcatcacagatctaaatgcaagttctccacttagtttgatcagtaataaaagtactgtagcattattaattctctgtttgacttctctatttcccaatttgatctgaacttaaaagaggaagaaaggattatgtcttgagctcctaaaacttcaactcaaagctttcattgtaatattctcaagaagtgacagtctgcataaatagcagattttttaaaaaggaaattcctcctagaactttgaaattttggttattatctgcccgagagcttggaggtagacctccgtagagaaatggcacacagagtttggggcctgacttcagatttccagaaccagaggatcatgctccctaataaaaaacaaagaaaaaggtctcatatcaggtagtgatggagtaagaggatgggccagggattaggggaagaaccaagagggactgattaacaaaaattacatctttggaagctagagaattcaccacaagcaaacaacaacagcaagttagattatgacccactttgtcacctttaatgtcgtattagatttaattctttggcaggtagagctgaatgaatttgcctaaacttttttcccaggaacgatagcaaagactagtaataactgaaagatctggccaggtatggtgggtcacacctgtaatcccagcactttgggaggctgaggcaggtggatcacttgagcccaggagttcaagatcagcctgggcaacatggtgagacctcatctctacaaaaaaaaaaaaaaaaaaaaaccaaaaattagccggatgtggtgatgtgtgcctgtggtcccagctactggggaggctgaggtgggaggatcacttgagcccaggaagtcaaggctgcagtgggccaagattatgccactgtactccagcctgggtgacagggagaccccatcataaaaaattgaaaataaaataaaatactactactattaataatgaaaactgaaagatccttaagattgtaaagaaaagtcagtctgagacggaaattttcactaattgctgaaacactgaaccaccactatgagtagaggagagatggtccaataaaaggagcaggagctggaggactattagaggaggaagccaagctacagcaaagctgttgagacagcaggtaagatgaggaaactataatggccgctaggaaaaaacaaatccatttagactccacagaaagataataaagctgccggtctgaaggacaatctcgttgtatattcagagttaaaaaagtcaccatccaaagcttttattgttgcagattgagaggtgggaatgcaatgcgggtggaggtgggttggggataatggaagagagacagagccagctagaatgtaactgtcagaggcattcaaatcagaatgactccatcttgaatacgggctgggtaaaatgaggctgagatctatggggctgcattcctaggaggttaggcattctcagtcacaggatgagatgagaggttggcaggactggtatcacaagataaaggtcataaagaccctgatgataaaacaggatgtggtaaagaagctggccaaaacccaccaaaaccaatatggcgatgaatatgacctctggctgtcctcactgctcactgtatgctaattacaatgcatcagcatgctaaaagacactcccaccagcaccatgacagtttacaaatgccatggcaatgtcaggaagttaccctatacggtctaaaagagggaaatccctgcctctttcccagaaaactcatgaatcatccaccgcttatttggcatataatcaagaaataatcatgaaaatagccaaccatcaactcttggtgctgctttgtctatggagtagccattcttttgtttctttacttctctagtaaacttgctttcactttactgtatggacttgcccccagttctttcttgcaggagattcaagaaccctctcttggggtctggatagggacccatttccagtaacatatatcatgttccttttgttaacctctgtataattcagtgcctgatattcctagcccatagtagttgaacaataaatatttgttgaataactaattggaagaatgaaagaaatgggggttggacatgttttcactaagtacaataccaactgtgaatcgtgctgtatacaaccaatgagtatcatctcaacccatgagacatgccattcattcagtcatttagtccataaacagtaattgagcatttgctaggttccaggtacaggatactagacccttgggaataactaactagtttttctgtcctgaaagagtttggagattagtagtagaagaaatatgttttttaaaaaaattaagttccatacaatattttaggtgctatcaaaactaccccaattttatatgtaaaatgtttatttagaaacagaatgcttgttaatcggtactgcaaggaaaaattggcattcagacaaaaagttttctcagcaagataattttactttctgcagaaagagtgctcctcgcagatggaacaatggcgagagcacacctgaacaatggagggaagaaatttttatcccttacgcagcttgtccttgctactgtgtcctgtctccgttggctggagccagaccgcacaatctaaactaaaacctgactggctaataatttaaaacttttctaaataggtaaaagcaatggaaagacaaaggaaaagaggaagttgcttatgaaaggacttagaaaagtaataatattcctgaataaggaaggggcataggctgtgagctgagacatgcccgtcagcacctccagcacaaatattttggttaaagtacaaggacatagaatgtacttattcctttatgtctaatagctacataggatagggcttaacagagagttaatagcacaaagcaaggaggattgaaggaagttagtctttaaaagaaactattatttctaacacttatgatttattctttaacaagaagggaaactctgaagaggaaactttttactttctacacccaattatcctactcaccgcacacatcccaagctccaaggcgtgaaccagctgggcctgctctctgctaggctttcctgacaaagtagggaaaccagacagacatgttggaagaagtattacggtttcatgaaatagcttcttctagaaggcaagagatagctttgctgtggcttgatatttgaaataggctatttaaagtcataatttttttttttttttttgagacggagtcttgctctgtcacccaggttagggtgcagtggcgcgcaatctcgtctcacagcaacctccgccccctgggttctagcaattctactgcctcagcctccctagtgtctaggattacaggcgcccaccaccacacctggttaatttttgtatttttagtagagacggggttttgtcattttggccaggctggtctcgaactcctgacctcaagtgatccacccgcctcggccttccggagtgcagggattacaggcgtgagccactgcgcccggccaaagtcgtaattattttaaacagaggctttcacgggacttccaaagcgcaccttgttctttccggctcattcccccttcccctctaacccttcactttcacttctctgactggatgcactgtgcggaggacacagctaagggctgtgaaaattcaagaataaagaaaagtcctgccttcacgcagctcgcactgtgaggaggtttaatcagggatggtaattcaaaataactcgtgtttaatcaccagtgcagatggtgtcagtaaacctgcctggggcgctgcttcccaacccccgccagggcctgcgccctgcagcccaccggaggcgtggccggagggcaggcaccagggcggaaggcgggggtcgttctaattccctgggggtagctaatggccatgcctggaggcgaagcttttcaaatgactaacttggaaaaccgccaaagacaatggaatctggcagaactgtggggagcaggaatcttaagcgtttgcatgttgttggggtagcaggggctcaagaaggggatgctcagggcaatagcttttttactaatctgtaagaaaatgttccagtattttaatagctggtacagccatactgatgcatacagtccagatcgatagatattggtccagatacagtggctatctgttcttttgccttccaggagcacagtttctcagaagaaatgttttttccatgtatataatcatgtaattcaaacaggagctgcagtttacttgcagacctcctaagtgacagtgtttggtctgggggtagatacgggccacaagttgctgggactattctttattcgtcctcattacttagcttagtgtctggtatagaattaggcactcgatagaattgtttaagaatgaatggacacaaacctttaactattgcttcgtttgatctcacttgtaaaatttctgcaactgtgtgactgctgtaatggaaagtcttatcctgtttaggcagcttaatataagttggtttagatatgtgcatttcacgatttctttgataagtttcaagaatttgctggcagctgtaactatgacgttcaaggcttatgtttactttttttttttttcctagtacaacatttacaaactccaagaattttatccatttcagaggtggttgtcagatttagggcaaaggacatatgtgggctttataaattttaaagttcggtacaaatgtttgttgatactcttgtttaattaaatgtaaaatagttgagaaccttccatgtacttactgatcacagtgttaaccattattacacagtactgtattgctccaagaatcaaagggcagcagctcaaagacaacacttggatgtgaatgagatgaagctgatcaagtcagaaggaaaaggaattcagatgccagagctcccaaggtctgaatagtgggcagtttcaagacaactctagttttctcctgatggctgaaattattagcagcctaagatcactatccttttcctggaatcaatgtgttcgaagggtgccagagtcatctagtgtgtttacaaaggataaaagtaagaggtgtgagtatgaatgttgttgttccaagaaataattgctccagggtgactccatgcttttattagtttgcgtgtgtgtgtgtgtgtgtgtgtgtgtgtgtgtgttttggtttttaagtaacaaactaactcaaagtagcctaagcaggataaagagggaatttgttataaagaagcaatagtgtttgatagaacccaatggcaggaatgtgtatgggccttgggaggagcctagagtcaggaactgaaaaaagatgtggattcttgctccgaatttgcttctcggcacacacctgcattcttctctctctgcttctctaatcaacatggcagtctgtatccttagttaaaatatttgtagcattaattccccattactcaaatgaccatcatttgaggctgtggagaaggcatgtccttgttgagtggaaggaagggaaattagaacaacttatatctatgggctattttaaatgtaaggtactatgattctaccaacttagactcccatatacacaaggattcacttccattccactttctgtctctgttaatagcacaattttttttgtcttatttattgtagtccttcatctttcatgtggagtcaatcactaggtcttattgggttttggtctcaaaagtctatcattaaataatattacttttcttagcagcataattcacaattgcaaagatgtggaaccaacctaagtgcctgtcaactaatgagtggataaagaaaatgtgatacacacacacacacacacacacacacacaccatggaatactacccagccataaaaaggagtgaaataatgtcttttgcagtaacttggatggagctggaggccattattctaagtgaagtaactcaggagtggaaaaccaaaaaccgtatgttctcacttaagtgtgagctaagctatgagtacacaaaggtatacagagtgatataatggactttagagacttagaaggcggagggtgggaagggacctagggttaaaaaactacttattaagtaaaatgtacgcaactcaggtgatgggtgcactaaaatctcagctttcaccactatataattcatctatgtaacaaaaacccacttgtaacccaaaagctattgaaataagaatctttttaataaagaaaatgccacacaaaaataatattggttttcttctaatcctgaaggccaatataaaaggtaacaaaagcctgagctctttaattaatgggtacaagttaagacagaatcacatcaggatttgaagttgaacctgagctcaaatcctgttcccatcactgctagctctctgaggctttcctctcaactacaaagtggagatataatactaaacaagcttactgggttgcttaactaatatctagaacatacttaacagtgtttctattaatgcgagaactaactgtaagcacttagtaaagagtagtcattattaagcaatgataaataaaagcatttgtataattctttttttagcttttgaaagccttgcacctagattttctcatctaatattcattaaaaccctgaaaggccgatcatatccccactttagagatggggacaccaaaaaacaaagagatgggaacacctagatatatcagagatcctagtttttattttatttatttatttatttattttttttttttgagacagagtgtcgctctgttgcccaagctggagtacagtgacgcaacctcggttcactgcaagctccgcctcccgggttcacgccattctgcctcagcctcccgagtgagtagctgggaccacaggcgtccgccaccgcgcccggctaatttttttgtgtttttttagtagagacggggtttcaccatgttagccaggatggtctcgatctcctgacctcgtgatccgcccgcctcggcctcccatagtgcttggattacaggcgtgagccaccgcgcccggcctgatcctagctttttgtaggtgactgacctaggtggtacaagatgtcctgtacttgttcatttattcacacatacaacacatatttattgacttcttaccataaactgtttaaggagcctggtggggataccgcataaacaaacaagcaaaaatagacaaaaatctttgtctagaaatatataaatatagaacattttatagaatatatgacatagaaaacagaaaaaaataaatatgaaaatagcctaattttcagggttttcctttttttacatacccttcatggttaacggttagtggttaatggggattacccattaactcccaccctccttcccagctctctcccaagacttagtttcaggaactagaaaattctgattcagcttgggtgcaatggccgctcaaagggcgaggcttattcgaagcctcaaattcagaaaacccagccagaccttggaagttaagaaggtggaaggcagatcgcggaaccagtgttctgatagttgtggttctctgagggaagccaattctggggaccggtagtggaaagctcttgcgctgtttccggccacctcagcgggaagcggagacgcaagcagctggatctccggtaactgagacatagggtataactgttgtcgcggcggaggaagtgaggacggcgccaagggccttccgggccagtgttggatccctgtagtttgtgaagatggtgttgctaacaatgatcgcccgagtggcggacgggctcccgctggccgcctcgatgcaggaggacgaacaggtgagctgcttactcacgacccgcgaccccaagtctctgtcagcgcgctttgccctcagcatcggattccttcctaggaccgggagacctttgtgacttcccgggcactcccgacctctctgaagtgcgcttttatcttttggtgtaggagagactaccggcgaagaggaaatctttcctgaaggaggagttaagttttttgtgttagctgtttctctttagaaaaacgctctggagaagtggtagctttggttgattgtgatcacccagtgttctttgactctttagggactttgttaaaattcaggatttctaattttctgctgctaataggactgctgatggataaatcctgggaaaaaatcagccaagttcttcaagtctataacgtggcacctgatccttgacctagcttgctgacatcttttgaaagtgggtgaggtaatattgccacataaaagcacctgttaaatttcagtacatcacattctttcaggattatccccagttcccaccttctccaatacgccgtaccacattcctgcaatacattgtaacttatttttttctttgtctttcaataacttgagtttcctagcgggcaaacgacgggtcttaatcatctctttgttatccataccttttacaatagctgctttatgctagtaggtgctcaaaagtatactgaattgattaaaaacagcactaactccagatgtcttaaaagaaagatgttttgtgttttagaaacacagtggaaatttctgaagtaagacaagtttctggagcaagcttgggaggttctgaagacaaagctgagaatggaatttatataatttgtttaaagtgatcaattttattttacttttccatacagtctaagtaaaaccttgagccttaaaaaaagatgagatattgaaaaaatagtttgcacatttcttctgttggacttttcattcatatattaatgcaaaaaatttttactgagcacatcaaatgtgccaggcatagtgttaatgcagggagttagagtacacagtctctacctttgtggagcttacagtctagtggaaaaatcagataaccaacaaactattaaaatgtagtttaactgctaaggagaaggaagagggttttgtgcttgaacatggaaaatatatctaagttggttttaggaaatcaggaaagtcttcccagaaggtatgacactaaggtaacagtaggatccagtagtaaggaactattattctatttggttatatgcctttttaggtttgatttggaaatatagttactttcacttttaggagagtggtgatacagataataaagttgcaggtcatgctaagtgaaatatattctattcattacataaaaacaaagtctaatctttgaaataaaccgtgaacaatttaacataccccgatttgctaatgtgaaatgtttttcaggaatactctaggaccatcctgcagaaggagtgtaattgttcaaatgaacctaggaatatgatttgaacaaagtagatagtgcaggggaatatccttgaaggatgtgtagtttgactaaaaaatagttttcctacagtgggtggctgtgtgttgggggtaggggggatggaatctggtcaatttttaaattattgcattgaattccagtgttagcaaagaatacaaagtgaacttgaaagtctacttaatattagtggcccctactctctgccatgatactttattgaaaaattaattgatttattgttttttaattataaatttggtattggtttcatattggtttatcaagatgggatgctttgtttaattgacaaggaaagaaattttacacacaaatatttttgtgattgtagtgccatagtattttcctttaggaattttgactttgaataataaagtttgcctaaacttttaatgtctgtaaagatctgaatcttaggcttacttttactattttaatagtatacagaacatttataaaagcgcctactacataccaaacactgtgctaagcctattaagttcatttttttatttaatcctcatactaccatattagaacaggtactattaaaatctccaataatagataaggaagctctgaggcttagagaggatagatcacttgcctaaattcacagctaatgagtggcataatgaaatttttcatcagggtttttccccttggcactgttgacatttggggatggataattatttgttcttggggactgttctgtatattgtgtaggaggtccagcaatattcctggcctctaccctctagatgccagtagtaccactacccttccccactttgtttgtttgtatgacgacaaaaatatttctagacattgctaaatgtctcatgggggcaaaatcaccccaattgagacccagtggtttttattaagtttttgtcgactcagacaaaaacttaataaccactgtactttagtgcctaaccactgtactttactgccttgttctaaggccttttaatgatgtcttacctcttaggagtccaggaataactttttaataaacagatatctcaaccaaacagttttatatttaatcaccttaattgtccaggccagataattcaatgtattttcatttttgtatgtttttgttttcttatcagtgtactttcagtatttacactgataatagatatcatattttaggtatttactaggtgcctgtacaagctgccatattaccgaagatggacagttattcagataatacaatagagagtaaaatttacaaaataatgtagacagagtattttatacagggtgtttcctctgtgtttaactgaaaatttagacttagggcaggaagagagatgagcgtttcttctcaaatgtggactccctaactgataccctgtttatcttttttcctcattccttttatggcatgtttctccttttaggatttttgcaatttctttatctacctttctgttctgcctcaaaattattgtattttctttcattttcctctggcatcgtgaagggcagtccagacttgaagaaagtgttagatctcaccaaataggcagcaggaagctccaagaaagcagatagataacatgttatacagttaaattgtctcacgctcccaatcactgagggttgattaatccacttactgtaactgcttttagaggaaagtggttggttcttggtgctgctggtctttgaccagctgagttcagtgggtattgatacccactgaactcagctatgaaaatgataagagctatgaaggcaaaagttgttattgatacaactagttgttcagcagtcttaggtgacagcaacgaaaagtattgcggttgtgtgtcaagttactaccttctatcttttgtaatatatagatccaaatcctacatttgctgttggataacctcaaatttgtttcacagtttttccagttattctgatccactgcattattggattactaatagatatctcataatcatatcatatacaaatttcattaatcttttctagatgaagtagaaaacacaatgaggatatctaaatatttttaggtggactggctaactgtgggccctttgtgactttgatcttgaaagcaaactaaaggtcagtatgtaaaacagtggttaggttgttttgtgagatctagatcagagctgccccatggtttcttgagcatttccaatgagttagaattacatagtaagacttcacctaaaaggtggatctactattgaaacaatttcaattatagagttagggtagcataatgcttaggagtaggggctccagggccagattgcctgcattcagatcctagttcctccctttttagcttagaggctaaaaagtttgacttctcaagtaaaaaattgacataataattctaatcacctcatgaagaataaacgagttaaataatgtaaagtgttcagaacagtggctggcagaaagtgaacacttaataatttcatttgatcatttctgaagaatcttttctaattccatcttgcctttcttttttttttttttttgagatggagtctcactctgttgcccaggctagagtgcagtggtgtgatctcagcttactgcaacctccggtccccaggttcaaacgattctcctgcttcagcctcccgagtagctgggattacaggcacctgcaaccctacccggctaatttttgtatttttagttgagatggggtttcagcatcttggccagtctgatcttgaactcctgacctcatgatccacctgccttggcctcgcaaagtactgggattacaggcgtgaacccccatacccagcctcatcttgcctttcttaaaggttcacagatcagaactgcacataatcgatacactggatgcaaatatgtaatgaatgaatgatttttcacattacaaaattaatttgtgcgtattatagaaagttcagtaaatacataaaagcaaaatgaccaaaatgttaacagtgtttattaactataatctgtactcaaattatatccattttggtggatgaccttaaacatatgtatgtgtgtataacattaaataataggtaataccgtaagactgtttcacctaattttttccacttaacagtgtttaatgaatattttctcatatcattaaactctatacagcattgttttaatggctgcatagtattccattgtatgaatatgccagaaagattattatttaaccatgaagattgtgctagcattgtgttctcaaggatggtaatgctaactgaaccagcatggtaaggtgttggttggcataccataatccctataaatacatccccagtgttgtatattggcagtctttacattgctgtttgcaaattcctgaaattgcagaatgcttttggccagtttcttatagttgatacagttgttagtctttttctcaggttacagtaatgtttacagtgcctcttgtaaagtcaaaggatttgtaccaatctgagtggcaattttttccatgtttcttcaactagtccttttaagattctcacctgcctttagcaaagaacatatatttaacacctgtggttgcagttatgtaaaaaataccgatgtcacagccccacctccaagatgctgacttaattggtttggtggtggagactgggcataagtagttttgtttttgagatttccccaaatgattctattgtgaagccaaggttgaaaatcaccgatctatgttgatattctttcttggcacttgagtagcattcccaacattatttgcatgctttttatctactcttgtgggttcagatctcttcagaatggcactggggaaacaaaaagattggtaagtaccattcaaatttaggaaaatagaatattgggcactagttcttattggctaaaagcatatgacagtattcactcttactggctggccatatattagtagtactgtttaatatgataattttgatataattattataaagtactgtttaatatataaaactgtacatacatacagacatacatatgttaatatagaactatttctcaaatatataacaaatatatgtcaataaaacaaataattgccataacagtggtattaaacaagataaatctacaaactaatacctcgactggactctgcctatctcccctggttcacctcatgcttattcaccttcttattcatactgaaatttccagttcaccatttttacatatagcttagaatcttattatcctgtaattgtacatttgctgatctgccactttatcattttattgttgcttccttgtttttattatcagcttagcagtacactatctacaattttaagatatcactttgtactttatcaaagttagacctcagatcctgggagaccctagcataaatacttttctacttaaatatttagttattaaacatctgccaaagggaggctattctttctatgtaaaataaataattccaaaataggattatttctttgcatcacatggcagtgtcctagtctgggttactatacaaaataccataaattgggtggcttataaatgacagaaattgatttttctagttctgcaaggtgaagatcaagcaccagcagatttggtgactattgagggcctattcctggttcatagatgtcaccttctggctgtttcctcacatggtggatggagcaagctagccctctggggtctcttttataaaggtactagtcgcattcatgagggctctaccctcatgacttaatcacctcccaaaggtcccacttcttaataccatcactttggggggttaggatttcaacatgaattttgtgggggataccagcaaacattcagactatagctgggtagctggcagaaagctcccctaccccacatgtggatggaaaaacaatgtctatttgcttcccattcttcaggcacttcctttccctgttggatctagtagattggagatgcatggttttcttcttttgaaatgacactgctggtttttccagtagatttgccccctctttttaacaaaaataattgtaaaagcagttagaaattgttcaggaaaatattacctgtaattataacatgtgaatgctattattttcatttttgtctgcatatatccctcgatattcaaacttttgctgtccaaacttgggaaccaaatagatttcttcagtaaagggtatctgacatgctaatctttgtctctacccttggtcatttttatgtaattgcagtcaaagtgttcataataatttgcagtcactagtacacacatttagttttgtttaaatgctaaaaactgtaacacttgtggaaggttctgctggatattccaacataaaaatgaaattcaccaatcttgttcctaggatattcccctgagtatagcacatgctgtgtagttctgtgccaataactgcaaatgaaatgggttaggaggagagtactgtcctaatagtggaaagaagactggattgaaagttaagagtgcttaagtgtatttgaggtatatgcttttgcttcttagcaaataactaatgcgatcatcttgaagaagtaggggttaggtcttcctctgtactctgaaagtaggttgtctttcctccgttaaaatgaatcttacttacctgtaaatgaaggacctcattcagagtgtcctcataatatggtgcttctcactaattgatacagcattttgtggaaaattcttaaatgaagatgtcttctttcagtctggccgggaccttcaacagtatcagagtcaggctaagtaactctttcgaaagttgaatgaacagtcccctaccagatgtaccttggaagcaggagccatgacttttcagtgagtgtaatcttgatttctttatgatcatttaagtgtgaaatacagtaacagaatgcctgataaaaaataataatttttaaaaagtaaagattacttaaaaatgttgtcttttgggaggagcaacttctctggctctaattctacaaaatggacatcttgttggttttttcagcatgcttacagtaatttaacctgttaacatgtgtctatgctgtgcccatcatgcaataatagataacttcttgctttaggactgtcttggagccagatatgtgtaggttagtacccttgctcaaacatttcctaacagtgtaactttgagcagctcacataacttctctaagcctcagtttcctctataaagtagtgaaaataaacataggaggtttgagaggattgtgagggaatccgtgtgtattacttagcatcttgtctgacacacatgggaagggtcaataattattagttattattattttgaaaaaagaaaattataaaagataagagcatcttaatcagtggttataaacgatacagctgatagaggactcaaaggaacattattggattttaaattatctacaaataattggtatttaatgtttaatacatgccaagtttgaagctgacaaaatgggaaggattaaaaaggaaaagagtacaagagcatcagaggaaaataaaaacggattagttaaataatctttgctattttagggacttagatagtaagataacttaggccagggaggaagctgctatgtttacttttaaaaaacaaaacaaaaattctctacctataaaagacaagtaaaaagtacatcaaaacaaaaataaaaccctaggcaattggctaagaaaatgttggacattatgttttatgatgtattaatttttataatatctgaaatattttctagaactctaattttcaacaccaaaaatagtcactcacttaatatctagtatcctcattttcaccatggtttagagaaccaagacctaggaaagttctcatggaattgagaagagattttcttctgcctgattcctttaggacattcataatctcatatcatcctttatttccatccaagagctattaagggtttattctttgccggaccttatattgagtcctgcatttaatgtccataccttttaacactgttctcttagtacagagagagacatatactcaaacaagtatactataatatcttcattgaaaagatgttgtaaattagatttaaatgaaatgttttgggaacagagagaaggaaggaacaaattcccatttgtagggggtaagtttgaagaaacgggacagaggaggggagtatatttaaagaagtttcacagaaaaaattatggtagaattgaacatatggaaatgaacaggatttctccaggtatttaaaagagcattaatggttagaaaaaacaatataagcagaagtccacaaatatgtaaagaacctagcatgttggaaaacagtccgccatttggtttattaaaatatatgatagaatgttgcttacacttgttttgaaaggctgtaaatataataccatggagtatgattttattttgtaggtattagggaacccttagagtttgtaagcagggtaatatggtcatctgtagtctctgggaataaaactgatggtatagaagatggtgtagactaaaagcaaagagaccagttaactcaggtgcccaagcaaggaataagacagctgtattattaatattattttaagggacctgagagatcatataatagtctttatcctttatggagccctaggatgcctcaggagccacatagaaagggcaaggatgggagtatatataatgctttgggcccctaaactcctccttatgttttaaattttttccttttattttcagttgacatgtaataattatacatatttatgggatacagagtgatatttcaatacatgtatacaatgtgtaatcaaatcagagtaattagcatattcatcacctcaaacatttatcatttctttgtgttgtgaacattcaaaatcttgtagctttttgaaaatacgtggtaagttatagctagccatatttaccctacagttctgcagaacaccagaactcattcttcctatccagttgtaattttttatccattaacttgcctctgcccatcctccccttctctctacctttccctacttctaatacccacaattctactctctacttccatgagctcaaaaattttttttggctcctacatatgaatgagaacatgccatatttatctttctgtgcatgactgattttatttaacgtaatgtcctccagatttatccatgttgctgctaatgatagaaattcattcttttttatggctgaatagtattccatggtgtgtgtgtatgtgtgtgtgtgtgtgtgtgtgtgtgtgtgtaaaaaacacttttaaaatccattattctcttgatggacatttctcttgattatctatccatagatattatgaatggtgctgccgtaaacatgggggtacagataagtttttaacataatgagtttttttcctttggagaaatacccagcagtgggattgctagattgtatggtagttctgtttttagttttttgagaaacctccatactgttttccatagtgtataaaagttctcttttctcttcatcctcaacagcatttattgacttttgtctttttaatagacattttaactggggtgaaataatatgtcgttgtggtttttatttgcatttacctgaagattagtgatgttgagcattttttcatatacttggccattcgcatgtcttttgagaaatgtcaattctgttccttgcctactttttaattgaattatttttggttttgctgttgagttgtttgagttcctcgtatgttctggatattagttcctcatcagatgaatgaaactagatccctatctcatcatatacaaaaatcaacttaaagtagattaaagacttaagcataagaccctaaactataaaactactagaagaaaacataggggaaatgcttcaggacatgaacctgggcgaagactttatggcaaagacttcaaagcataggcaacagaaaagaaagtagacaaatgggactgtattaaactaaaagcttctgcacagcaaaggaaacaacacagtgaagagacaacttgcacaatgggagaaaatatttgcaaactcctacttaaactaaagaacctctgattttatctgatatatacattggccttctgaatataagttttgcttgttatatatacatattccatatataaatatatatatttgcatgtgtgtgtgtgtatactatggctaaaaagaagttggaaaaccacttagtagcctaacatttttctaagaatttctcagatgtgtaatcatatagccccttccagagtgcatgggcgctcatcatcacaaaagaaagtcagttccattgttgaaaagtttccagttgattacagagtcctcctggactgtaaattaaggagtcttattagtcttgtacccagtaaacattatgtcattaaccttacatttctatccacagaaatttccagttacagtgttttcctttgtggctggaaagagtttaaatatgtgtatgctagtttaccatatagaatcaaagggtggatggagtcacaactctgaatttttcaggaaaaagtcttaagtattaagcaaaaaacaaataaccccatttaaaaaatggacaaaagacatgagcagatatttctcaaaacatactagaggctagcaaactaatgaaaaaatgcacatcactaattattggagaaatgcaaatcaaaaccacaataagataccatctcacaacagtcacagggctattattaaaaagtcagaaaacaacagatgctgatgaggctgtggagaaaaaggaattgcttatacactgttcgtgggaatgtaaattcagccactgtggaaagcagtttagagatttttcaaagaacttaaaacagaactaccattagacccagcaaacccattaatgggtttatatccaaaaggaaacaaatctttctaccaaaaatcatgcacttgcatattcattgcagcactattcacaatagcaaagatatcaacctaggtacatgttagtggtggattggataaagaaaatatagtatatattcagtatggaatactatgcagtcataaaaagaaatgaaatcatgtcctttgcagcaacatggatggagctggaagtcattacctaagtgaattaatgcaggaacagaaaactaaatactctatattctcatttataagtttataagctaaacattgggcactcatggacataaatatactgaggacttactagaagaggagggaaggagggggcaggggttgaaaaactattaggtagtatgcttagtacttgggtgacgggattgtttgtaccccaaacctcggcattatgcaatatacccaggtaacaaacccgcacatatacatcctcaagctaaaataaaagtttaaaatgttagttgaagaattgtgtaatgggctgggtccagtggcttacacctgtaatctcagcactttgggagactgaattgggtggatcgattgaggtcacgagtttcagaccagcctggccaaaatggtgaaaccccatctctactaaaaatacaaaaattagctgggtgtggtggtgggtgtctgtaatcccagctatttgtgaagctgaggcgtgagaatcacctgaacctgggaggcggagattgctgtaactgagatcatgccactgcattccagcccgggtaatctgggtgatcgaaagagccctgtctcaaaaaaaaaaaaaaaaaaaaaaaaaaaaaagagaatctaatggatgaaaaattataataaatatgtctaaatactccttttagaatatacggctaataggctgggtgcagtggctcacgcctgtaatcccagcactttgggaggctgaggcgggcggatcacgaggtcaagatatcaagaccatcctggccaactaacgtggtgaaaccccgtctctactaaaaatacaaaaattagctgggcatagtggcgcacgcctgtagtcccagctgctcgggaggctgaggcaggagaatggcttgaacccgggaggcggaggttgcagtgagccgagataatgccactgcactccagcccgggggcagagcgagactccgtctcaaaaaaaaagaaaaaaaaaaaccaaaaacaaaaaaaaaagaatatacatctaataatgggaagatgtttgctttctgattccaaggatttgcggttttaaattgactctcgtttagccagcctcaaagtatttaggctagatttttaaaaaagtttgcatggtacagagattctgctttaaactattgtcagtgctattactttacagacaactttgtcttgctttttatgtctcaccagctacattattgagcagggggtgtgtgatttggttttatgtgaagctgccttccctaagacgttggcttttgcctacctagaagatttgcactcagaatttgatgaacagcatggaaagaaggtgcccactgtgtcccgaccctattcctttattgaatttggtaagtttttgcccctcacttctctctatcaagggagcaaacaatatggagaagctatttgttacactgatataatatttatacattttttctgatgtttacttgctgaagttttagcttctgcttccttttccattccacttctttttgtctttttgagtgactaaggctttgttctgaaaagtaattttctctagtcttttgatctttcccccatagaaattgttgccttttgccctttctgttatttggtttgattcttctttagagtcacatgtgacaggaactttgctaaagatctacttgattggcatataatggctgagttcttctttaccccagtccacagactcacactcacaataaggctcattttatggagatcagaattgggaaatcagaaagaatgatgttttgtttcttttagtagaataagatcctctaattaaaaaaacaaaacagaacaaagaaatagaagatacctggtactcatggtattggggtataatatttactacattcaggaatggtgagcataggtgtctgtatttgtacaagaattatagaaagactaattactaatcagacctggtaaagtatctgatggtaagggatcaaaggaaatgtcctaagtacagtaagtacagggagtgagaacaagtaggatcaggctatatcgctgcaatttttagttaaaagagaaattggttttactggcttagaatttttgaagtgtttcaagtttgctagataaatgggtcatcttgctttggaaaaacactctagtgtttcataactatatactctccaagtgctgctttatataatgtccagtttttcaaattttatttttatagacagtaatactcccataaacctccctcaaaaagaagacaaatgtatcagggtcatacaggaaacagatggcacacccaaattagcttaagggattatatacaaagatatgactaggctgtaggagaattacaaggtacagtaacctctgaccagtagcatactggttgttaccatccctaggcctgaatgtataagggggaggagcagtttctgaaactgaaaaggagaaaatttctagagaaggccaacttgagaggagcgtaacttttggtagagggatacttccagaagaaggttatttccttctctgaaagaagccaggggaataaatacccggacatcactcactgtctgttctccttcttccctactgttggggcttcttcattgcctgaacctaactggcacagagcaaggagtctattgaggcgcttcatccaagtcagcttcccagtgcagaaagcaaggtgcaggagggcagagaggagatctaaagaggcaaatgaaaggggtacagcacacttaaattaagatttttgccaaaagttgaaaatatctttaataataagtcgttcttcctatagttttgagaaatactgatatgagcaaaagatggatgagacttcagtttttatttatttatttatttatttatttacttagagacagagtctcgctctattgcccaggctggggtgcagtggcatgattttggctaactgcaacctctgcctcctaggttcaagtgattcttgtgcctcagcctcctgaatagctgggactagaggtgcacgctgccatgaccagctagctaatttcggtatttttggtagagatgggagttttgccttgttggccaggctggtctcgaattcctggcctcaagtgatccacccatcttggcctcccaaaatgctgggatttatacgtgtgagacacagtacctggccgagacttcagttcagttttatattggtattttggaaaactccctattacatacttgctttacctgaggtttaagaatggaatgaaactgggaatgtatattagagaaaataaggtaaagtttctcagctttttaatgatcatgagcccttttgccatgttaggctgtaataatgctagagtgttaccagcatccttttaaggaatgtgtagaggtaagtaacacttagcctaagggtcctcagaatactgtttgaaaatttctgttttcaggaaaggcttactatagtgggtcttaattcctctaaggattctgatagcagccttagatagcaaatacttctaatttaaaggtattcaaaggacatttctcctgaatggtcgtctaattatacctttacatcttacaaatgaaataatcaaagcctagattttgatattcaaccaagagtttggttaaccatggacagtggcaaatccaggaataaagtcagaactgttttggtttttttgtttttgtttttgagacagagtcttgctctgtcacccaggctaaagtgtggtggtgtgatctcagctcagtgcaacctctgcctcccaagttcaagtgattctcctggctcagcctcctgagtagctgggattataggcgtgtgccgccacgcctggctaactttttatatttttagtagagacggggtttcactgtgttagccaggatggtctcgatttcctgacctcatgattcacctgccttggcctcccaaagtgctgggattacaggtgtgagccaccgtgcctggccaactcagaacttttaatttcctacctcagtactttgatggccatgaaagaaatggtcagttttcttcatcattctagatactttcattcagaaaaccaagaagctctacattgacagttgtgctcgaagaaacctaggctccatcaacactgaattgcaagatgtgcagaggatcatggtggccaatatcgaagaagtgttacaacgaggagaagcactctcaggtatctaaaagcaatgagtcttatgaagaaatggttctcattccatagacaaggatagcttattttgcagtgccttttatgctattagattctacctagaactgttaagaatttatctcccagaagtacattacattacaatgcttccaatatattttttttcctagcatgattagtttttgttgagttggaacagtgtaaaggactcatccatattagaagcaatgattatttctaacatattcacaaaattaattaaattatataacttgtataaattaagggaaatgaatgagagaaaactcaacaatgtattgcagtggttttttgagtagcctctttgggagactttactgctgccagatcaatctttataaaatgccattttcatcaaagcattcctctctgaaaaacttttaaatctgggactacaagataagatccagtctgacttatttttccgtcagtcagccattgttattgagagcttgttatttgtaaggcgttgtgctctacatatggaaaataaggaagatgcaaatgtctgtcattctctagttcacaaacattcttctgtagccacaccagcttctttactatccttagtggtccttagaacagaatactgccttatgctggacctgttctgtatgtaagacctccataagaactgtctctttaaagaacctttctctgatccttatagcctgtatcacattaatctcttctgtcctttaaactcctaaagcacttagtaacataatggttttagcacatattacatgtatgtgtgtttacctaatttaccttaaatatatttattaaatacctcttaccatattaaatatatatttaatatatattaaatatatttccatataacataagtatatgtttcatatatttatattaaagtaggcaaacatatttggataattaaatatttttatataatttcatatatttttttgagacagagtcttgttctgttgcccaggctggagtgcaatggcacgatcttggctcactgcaacctccatctcctgggttcaagcgatcttcccaccttatcctcctgagtagctggggctacaggcatgtgccaccacgcctggctaatttttgtattttcttagtagagatggggttttgccatgttgttccggctggtcacaaactccagggctcaagcaatccactcacttcagcttcccaaagtgctgggattacaggcatgagccacaacacccagccctttatataattttaaaagtgtaggtaattaggtaaaattaggttaaaagtatatgtatatttacctgatatttaaatattacctaagtgtttaatgtggacatgtaagctctttaaagatagtgcttatgtattttatatctgtttcacatactccttatatatcccccacagaaatggtcacaaataggttccttaataagtatttttgaattcagccatgctatatattcattagtaagtgagttttcttttattatgaactacaaactttaacctttttttgagtagtgagcagttattcatttaccttcacactctttaaataccaaattttgagtgagtgagtgtgtaaggttttgtcatacagacttgcaattcctatatgggataaagtagactagcacaggaatttttcttgtatcactcatgcaagactctaaattccttaaaggcagggatcatgtatattttgatcactgttgtatcctcagcacttcacatggtgcctgtcacataaatatttgttaaatgacttctccaagcaatagctttgtctttatgttatcctgtatttcaaaacgttcatatataaattctctcaactatgacttgtttcatagggtctaataattgttcctctgctgagttattctcagcagatttagattcatttagcaaatgtttattgagcactaactatataccaggccctgttctgggcattcaggatatagcagcaaacacaataatttaaaatccctgtccagtgaagtgtatattcttgtaggctctgtaaaaagatgccctgtgcattgtcatggttatttctcagtccctgactcttcttccgtcactagatgtttttcttactcatgtgatcagttgctaattcagacgtggctgtcatgcctgtgttattaagtaacgccatgtttcccaatcaaaaccagtctctattaagcaactccaaatattccaaaagcattctttaaggaagaaacagccggattgcaaaatagttttttctgaaatttcaagaagtgaaaagtttgatcagaatttattatgtcaaatggagagtttgtgtttattattaaaatatgccctatattttaatatggtctagcttgtgtctatctggctatttctctaagtgtttagttaactgttataagaagataacaacattacaaatgtccttgggggtgaaaaaacttgccagaaaatactaaaaagcttaatttacttgcgtttttttttgtagtacttattgtattttagttacaactttcctatgtctattgaaatataaatcctgatagctttaacttcatagtagtctctactatgtggagaatcttagaaatgttagcagtcatcattgaagtatagcttaagactgtgtttggttaattgaattttctggttatctgagtttgttttacatggattatcattatcgtttttcaaaatataagagaatatgattcagaccattagaagattatgaagataataattattaacatgtaataattattataatttatcatgtgcaggcattgttgctcactttacaggcaatctcatgtacatacaactttatgacatagttactgttattatccccaattatagatgaagaaactaggttttaaataggttacatgacttgaccaatgtcacataacttgtacaggtgatatctgaaccaaagagtctgaggccagaacctgcacttctaaccaccttactatatagcctcaaaaattcagacataatctgatcagcatcatcagttaattagtatatgcaatgttagcctcaaaataaaaatgatgatttaagattcatggttgttgcagtgctgctcattttggttatttttaatgccttaatactttcggtaaaatacttccagggactaattaatgttttccttttttcctctttgacagcattggattcaaaggctaacaatttgtccagtctgtccaagaaataccgccaggatgcgaagtacttgaacatgcattccacttatgccaaacttgcagcagtagctgtatttttcatcatgttaatagtgtatgtccgattctggtggctgtgaaataatgaatacagtcactggtaagggagaacctagaacccagtaggtgtatattttcaggaaactgagctcacagagatgtgtattagaatccaagtggaacttctgcctctaaagaccttgcaagaaaagagatgtcctgaaaatgaaaggttgcacctcatttaatgaagcttaaccctatgtagaaagtctctttcgggggcagaggctttctctgggtgccaagccatatatattagggaatagtagattgttatttcgttttttccctcccagtgcattttaaaaacagcactggctggggcattctcattctctgatggagccatcaatgagatttaacttagtcaacctgtgctagcaacattctgaaattccttcaaagaaggcagtcctttgggaaggtgtttttttttttgtttttttgtttttttgttttttttgactctaatcaacattccttttgttggtgacatttgtgattttcagtaatctgagtttttgatggccttttaaacaagactccagtatgtgaaagttaattgctgtgctccacagatcttgtctattggcccctgtagaaagttaacctttgttgttttccttttataatttgcttattgcacaattgctttagggtaagtgaattatattaagatgccttgaaattatagcactccttgattaagaagctaaaatgtttctctcatttactccttaaacaaaagacttaaattagtttgggtcattattacttttattttgcagcatttggtttgttattagtgtaagagcaagtataggatatggagaggcccctggcttcatgagaacaaaggcaggcccaggttataattacagctttctcctgccccttctttactttctctaccacagttttctccgctgtttgttttcctcttgccacaatttgctaacacttaaaaaattttcctgcacccagtagtttcatatcctgtagacatcctcttaggacattctcaaatttcaaaataaaaaatattcatctatgtagttaattaaagttaaagtttctgcagatcaactactcaaactactaaatacatttacctgagaaaaagtctctgagagcacttcattcctgttttagttcgtgtaaattctctgagaatgttctggagatagataactcatttacagtggtttctattaactaattaaagtacccatgattttttccttttctgctcagggatgatggagatttccttttaccttttttaatggggtaaattttttaatggggaaaataggccttttaaatattattgccagggtctgcaatataacttaaaattcctgtacatactgcaaatatttctttaaattgcacaggaaaatgagcgaactttttatttcttaatatctttggcaaaaaactttaaccagtaagcaattttataaccctgagggatcatcaaagatactatcctgattcctggtaaggaaaaatatattatttccttataacaaggcaaggagaaatgctattttattcctgataatttatatagctagaataatttttttcctttcttttatggacctaaatctgccaattgggaattttgtgcatgaaatatgaagttactttttatagataatcagtgcttttaagtccctaaaaggctcctgctgaagtaatgatgatgttcataataaaagcctttgaaaggctgaaaacctacatagtggtaccatagtatttggagcttctataggagtggagaggggcagctcattgttgagagttgcatgctgcaacctaatggtcagcaatgaaagaaatacttgtagaatgttcacttcagtgtgaagttttgttatctagttaatttatatacatatatcctttgtagatacatttctatctaatcttgttgagctaattaagaaataaggggtggggtaattgtcaacaaagggagaagaaagtggtttaagatcagggcagcagaaaaattagagaacaagaatatcataatatggctcctggttttctttataagaggcagtgggaagatctgactagatgaaatgtatcatcaaccaaactggcatctaaaatagaatgggataaatactgtatggggttattggaggcatattaagaaaggacacctaatttattttgggaagaagtatgttaagagaagactttctagagaaggagaatggggcattctaggaagagtcaatggcatgtgcaaaggcatgaataaagacagtgaggcatgttttggaaatgtaacagcttgattcagcttagcccatagggtaagcatagacaacagaggagacttgaggaatgagaactagatgggtacactatcataaagggacttgtctatcatgctgaggagtttagaccatcttaatggtagtggccaaggatggcatcagatttatagtttcaagtgatcataatattggcataaaagatatattagggaggaagcctgaagtagggagatgaaaataaggagccatcaaaggcagaatgaaacttaggcagatttcaagtgattttcaaaaatgatgtgatcagaggtaccagataataactattacataacactttctttgttaggagcttatttctcacactgaccaaagcttttgaagtaagtactctttacaccactatataaataaaccttacaaaggattctgctttgaggcatgagagagttaagtcatttgcccaaagtcacagagttagaaagtaatagagctaagatttgaacctaggcagtttggctccagagtctgtgctcttacactatattaccaccaagaggtcaaataaataccaaagaatgtattttcgaatttaacaatgaggaacttaatcatacaggcagaagtaattccagagcaccggagacagaagccagattgccatatgggttaaagagtgtgtaaaccactaggaagtaaagacatagaactactctcacaagtgcttttctggttattgtgacgctgaacttcatggcttgttttaattaagacatcttacaagtgtcaaaatttggaaatatttggacactgtacactctggttatttaaatatctaacagtggttcttgagcattttgagaaacctttgaaaatctgatgaaaggtatgtgccattactctagaaaaatgttcctgtgtacatgcacatcaagtatcacatactgtttcaggctgttcaaagactacaaagtctgttcatgacctaatggtccatgttccctcagttaagagctccagagataaaggatgtggaactcaaaggtaagtacccagagccttgaaaactccatttgtgacttggaagaattctacaatttgaattaactttgtggagagagatatatttttgaaaaattgtgtgtaccaaaaaaatttcatatcaaataatattttcctgtagtgcattcaaggatctggttccacagcaaaaaattgttttggtctcagttcctcaaaatcacatttaaggagcttgagatttatattttctacttaataagtcttacaaaagcaagttaagaaggaaaatggacaatcatttctgcacatgtagggtttaataaaacatgtataatgaaatatttcatattttaaatttccaccttattggtagctttcatgacaaagggctagggtgctggtggccatacaattaaggtttttggttagttagttagcagaactaaatgactcctacctggtggctttttcttttgtttgtttgtttggttggttggttttttcccagatggctcaggaggaaggtaaatagcagtcattgtatgtgtgacagagtttgagatagaatgagcatattgaatcccacatcctgttcttattactgtcaggcagcgttgacctagcagtataaaactatctgaagcaatgtagtcactcagttctcataaagtttatttcaagtactgtaacaattcatgtttggattagaaaagtcactagaaatttgacttccatatagtaatctatacttttttctctcatttccttcactttttgagccgtaagtgtaaggcattttggtggtattattacaatggttatgaggagtttctttgcttgcccaaggtcacatagctagcaagttaaagtagattcaaatccaggcctgctagataccaaattattatttaagagtacttttcactactcctaaataatgacacagatatgtttgtcttacacatttcactttattgtcaagttattagtatgtttattttcaaaaggtattttttgcaatttctttttattattccgtactttttaaatttacttcattatcacgtcttcctttattctttttaaatagtttttgcttttgttattttgttttcccttttttactcttggtttgtaatacatctttccttatttgctcctttctcatttgatctcaatgttaatccaactgttttccacatctgattcactaaaattttagccctttaaaaaaaaattcctgtttttcctatctccttttgcccattctcttctccttgcctcacttcttttatctttttccattttactttcattttttgtttctctagatgttgttttgacatatgagttaatgtactggtacaattttgcatctgtaaattagagcttcagaatcaactgagtgtatttattctttatttttaggcctcaatttatcttaccttttattgattttataatatactatactctttcattttagtctgcatatgttagccaaagaagatatgcccctgttttaagaaatctctgtaaaaaatgtcaagtgtgacaagaattcttcaagaaacaagctcctctagtttgtcttctatatttagagcttcaacagttacctatattactggtaactcccaaatataccttcaaacttgttttttgggcccaagttttttgcttcatatatatctgttttgaatatcccataaataattgcatctaaagcatacctccactccattgttctcaaagataaaaccaaacctgtgctgcttcttatatttctagtatttaagcgtcacctgccacccctttacctgagctacaagtcacgcattgcattagactcctctgctttcttctttcacctctaactagactattcaccaaaaatttttaaatatataactttcaaaaggtattttattacatcatttccatcctttatgtttgggttcaagccctcattaactttaacatggattcttggagtaccctccttactgattttgttacacgtgtccctcttttagtcagtactaccatgataataccatggataataattttttcatttttatttttagtcttgctctgtcgcccaggctagagtgcagtggcgcgatctcagctcactgcaacctccacctcccgggttcaagtgattctcctgcctcagcctactgagtagctgggattacaggcacctgccacagctcctggctaatttttgtatttttagtagagatggagtttcaccgtcttgaactcctgacctcatgatccaccctcctcggcctcccaaagtgctgggattacaggcatgggccactgcgcccggccaataatttttcttttttttgtgctaatcatactacattttctttagaataaaagatcacatacttcagtttgccattcgcagtctggccccattgtgccattctagacttacctcctgccactccccaccagctttgttttgtcttagtcacacaaaataatctagcgtctctaaccagtcaaacattttaccttgtgccttggctcactctgtgccttttctccagaatatctttctgtgtacttttctcccatccttttacctttaaacctgctgctatggtttggatgttgtttggcccctccaaaactcacgttgtagttcaattgccaatgtaatagtgttgggagatgctacttttaagaggtaattaggttgctaagatggattaacatctttctcttgacactgagactgggttttcctgggaatggttagttcccaagagagtgagttgttataaaacagtgctgcctcttctattttgcgctttttgtttgcacaaactcggtccccttctgtttctctacgatgttttgatgcagcatgaggcagtcatgagaacccaccagatacagctgcctgatcctgaatttcccagccaacagaaccaagtgctaaataaaactctttttaataagttacccactctcaggtattctattatcgcaacagaaaacagtttaagacacctgctaggctcctaaccttgaggggctagaaaacaaagccagaggtccagtaccagcctcctcagagttagaatacacagctcatgagtgctgagctcagccttggcccctacaatcttccagaaatgaggccacttggctgagcccattatatgcaacattcagacccccaagggcatcaaagaagacaaaagcagaaaaacctatccaagaaacagcaacttcaaaggttgaagcaacatcagaccacacaggtgagaaccagcacaagaactccggcaactcagaaagccagagtgccttcttaccttcaagcaactgcgctatttccccaacagtggttcttaaccaggctgacatgacaaaaatagagttctgaatatggataaccttgaggaacatagatgcaaaaatcctcaacgactcaatttgctggactagcaaaccaagcccagcagcatgtcaaaaacgaatccaccacaatcaagcaagctttatccctgggatgcaagtttggttcaacatatgcaaatcaataaatgtgattcatcacataaacaactaaaaacaaaaaccacatggtcatctcaatagatgcagaaagggctttcaataaaattcaacatcccttcatgttaaaaaccctcagcaaactaggcattagaggaacatacttcaaaataagagccatctatgataagcccacagccaacatcataccgaatgggccaaatgctagaaatactccctgtgagaaccagaataagacaaagatgcccactctcaccaatcctattcaacatagtactgagagtcctagtcagagataacaggttagagaaagaaatataagacatccaaggaaaagaggaagtcaaactatctctgcagacaatatgattctgtagaaaaccccatagtctttgcctaaaagctctttgatctgataaacaattagcaaagtttcaggatacaaaattaatgtacaaaaattagtggcatttctatacaccaatagcattcaatctgagggtcaaaatcaagaatgcaatctcattcacaatagccacacacacacaaaaatacctagaaatatagataacgaggtgaaagatctctacaaaaagaattacaaaacactactcaaatcagagatgacacaaacaaatggaaaaagattccatgctcatggataggaagaattagtgttgttaaaatggctgtacttcgcaatgcagtttatggattcaatgctattgctatgaaactaccagtgacatacttcacagcattagaaaaaaaaacttttaaaattcatatggaactttaaaaagagcctgaatagccataacaatcttaagcaaaatgaacaaagctgaaggcattacactacccaatttcaactatactacaaggcttcggtaaccaaaacagcagggtactggtacaaaaacagacacatagaccaatggaacggaaaagagcccagaaataatgctgcacacctatgatctgatatttgaaaaaagttgacaaaaacaagcaatgagaaaaggactccctattcaataaatggtgctgaaataagtggctagccatatgcataagattgaaactggaccccttccttatgccatatacaaaaatcaactcatatgaagtaaagacttagatataaaacctaaaactataaaagccgtggaagatagcctgggaaatactattctggaataggacctggcaaagatttcataacaaagatgccaaaaacaattgcaactaaaacaaaaattgacaaatggaatctaattaaagagctttagcatagccaaaaacaaacaaacaaaacagtgaacacggtaaacagataacctacagaatgagagaaaatatttgcaaactatgcatcctagagaagtctaatatccagaatttataaggaactttataagcaaaaaacaacctcattaaaaagtgggcaaatgacacgaacagacatttttcaaaaagacatacatgtggccaagaagcatatgaaaaaatgttccacatcactaataattagagaaatgcaaatctaaaccacaatgagataccatctcataccaatcagaacggctattaaaaagtcaaaaagcaatagatgccggcgtggttgcagagaaaatggaacacttatatagtgctaatgggaatgtaaattcgttcagccgttgtgcaaagcactttggtgatttctcaaagaaccggcaacaattaccactcgacccagcgatcccattattggatatatacctaaaggaatacagattgttctgccataaagacacatgcacgcatatgttcatcgcagcactattcacgatagcaaagacatggaatcaacctaaatgcccatcagtggtagtctggataaagaaaatgtggtacacgtacaccgtggaatatacacagccataaaaaaataagattatgttctttgcagcaacatggatggagctggaggcaattatcccaagctaaattatgtaggaacagaaaaccaaataccgcatattctcacttacaagcgggagctaaacattgagtacacatgtacacaagggaacaacagacaccaagacctacttaacggtagagggtgggaggagggagaggacagaaaaactacctattgggtactgtgcttattaccaggtaacaaaataatctgtacaccaaaaccttaaagaaaagtgttttaaaaatgtaaaataaagcatatagcaaaacaaacaagacacctggtaaagttctgctcttccttcaaagacccagctcaaatgtctctttcataaagcctctctgacattctcataccccccttctctctgacctgggagaagctgtgttttcattctcccacaataacttgttcatatttctattataaaacctacaaatttaaactagctgtcagtgcatacttgtttgtctccttggctatgtgccttatgagatgcctgggatagagatcaattattattcaatttgaatccttggcattgggtgcggtggctgacacattggaggtgggcaacaaatattcgtggtataagttcactgaattacagagatgtatgcataagttttttggaactgggtttcatgaatcataggtacacacaatttgaataaaagaagaaaacaaagtggggcaaaagggtgtaggtctagtaatgaaatgggaaaagaaaggcacattgaaaagtcgcaacaaaagagagaaccagtacaattatatcaacatatagtaaacacattggagaagggaaaacaatacagcaagtgaaattgattctttggtggcagaaacaattgaaaggtatggaggcaaagaaggaggagaaattaaggcatagagataaattagacttggggagaaagcacagaagtcaaatatagcaacagatcttggactgggaatgtttccaattgaccattatgcttacgattacttttatgttgtggagacaatatttaatgagcatttcagatctgttaactaattttttgaaaaagtgactccagttcagtgataaataccttgaccaatatgccatataaagtaagaaatattttaccatacccaagaaactggttttaccggcttagttttgaccaactgatggcaatttgtacctgctaaactcccaattttttacttgctggttgtgtaggtaggcagtgaggtttgttggactgggcatgcagggacaagcagttaggccaatacatggactgaagattatatctatttatctgccttttgtttagctatttgcataaatatacagagtgggtttatttgcacacttagagctttagaataaaagaactttgactttcaaattggtttttcttgattttttaaaatttttatactccactttttcttccgtctttctcaaactcatttttccctagtagcagagttgagacttaatattacaaaactctgcttgctttaaagaatctaagaagaagaagaagaagaagaaaagacactaaagaacttccaagcagaagtttaagaagttctgctatagcccatccactcgtttgtggaatttaaatatatccgtttttgccacaataacagcgtagccttgctagaatcatatacaaagcagcagatttctttctataaattactggacactgtggtgtaatgtagacattgctgaggagggatgtaactgcaacagaaacaagttacttacattgcatgcagtagggaagtgggtgaaaagagcattgaactctgagtcgggagacgacttcaaggcccagctcagcactctagcagaactttaggtaagttttttagacactatgtacttcagtttccccatgtgaaaatgagaataacgtctgttctgcctacttcacttgaactatttgaggataaaagaaggtaaaatgcaataatggtcatgaagattttataaaccttgaagtgatgtacaagtataccatactgtttcacttttattactattataactgtttaaaaaagcatttgtgaccagtacaatcctggcttttctctggagactaacatccagtttcatagttattttacttttgatagggaaaagggaattattcctgttatatattgcaatatttaggatcctctagcaatttctcaggctaagacttcatgttcccagaagagggcagcaaaactccaaaggctctgccttttcctcaattaaaatgtctaaagcagtttttccttgagaggaaaagaactatactgtaaagaatagccctttaaaaatgatggtatttaggtgacaaagctaatcctattacaataaatataacattcattccaaataagatttttccttttctctgtcctgtgaagaaaataattgactgtttcttcaatctcatgttaattatttgacttatatttccagaaactcctacccatgtttttccatttaactctagatttgtagatcctacttagcaccagtttttaaataaattgtttcgtatgtgtaagagaaaaggtgttcaggcctgtttatagcttaggatgcctacctaagtccaaagagtgatcctcagcagtgtctaaatgtgttcctatcatagagtatatgtttgtcattcagataaaatgttgtctacatctaatctttctcattctttcattattcaaatatccccgtgcctttctatctttagtcagtgaattatcttgtaatgacaagagcaactaacatttgaactgttcttaactcacttaggccggaggttgcaatttttttttgtcaaaaaatcagaccttggtgataacttgagcagtaggctataagtaactagtaggctagcttactataagtaggctaggcatattaatagcgtataaggtgctctcacagacatgttttccctttgatactcaccatagccctgtgaagttgatagctactatcccccattttacagataaattttctaatctgtaatcaaaatagctgctctttgcttgaagaaaaagtccagagggacaccctatatgtcaagagagctccagggggtgggtaatttctttcataattgctagaagagccaattctgaatgtgaggctttttctatctgctttattacaaccagagatggaataggaaggctttcagttacagtttatcaattccttctgcttttgccagttaatctctagctttactcttttgaaaaaactacctgtttcccactccacttctgctaccaccactaccaagtcagagtcctctttctattccagccaaacctcttcctgttcttgagaattgcatcacattcttggcttaacgtaaccaacacccccacattggcaccagggagtgtgtagcccttctttattggctgaaagttcttgtctggtgagcatggaataagtcactcacttcctgaatttcagccctggctaaatttgcttctggaaaaacatatatatattcctcagatttttgtctgttggtttgcaaatctccttcactccagccctgtcctggaatgagcaagatttaccaaatagggacagcatgaaagggaatttagagggtagaggtagagggaaaaggaatagtatgtgtagcttgctgaatgagatgtctgctcttgctgtttccatttcttcacttctcaaacaatttttaacccaatctaaactggcatcagctcccattgtattgaaagggctttcactcaggacactaacgcccccccgccacctcccatattactaaatccagtggatacatcagccttgatcttacttggcatcagggtagcatgtgatgcttttggtcacatcctctttgatagattcactcttcctttgcactattattttttctctatcttagtcatgggtcttcagcatcctttgcaagctcctctttactcctaaagtactggtgttcctcagaaccctgttctatatcagcctcttttctctctaaacattttctgtgagaaatatcatccctttccatggcattattgagatccatctgccaattatttccaaatctctatcttccctgacctcttttgactgctttctagaacttcttcaattagaaattcctgaaagcctgttaaccaactccctccctcaaacctattcctccaataatgctcctcatccaaacatatgccacaccatctacccagtttttctaggcagaaatgtaggattcatccttaatgcctcttttgctcaccttccacattcagtcaataaccaaattcagtataatctacatatttgaatccatcagtttctccctgtccccactggcctaagtgatcaccatctatgtggcgttttgcacatccctttgctagtttcctgcccccaggttttctccccttggatcattttccactaaccactagatggttctttatgtaaatgcagttctgtaaattcaccacttgtgtttaaaatcctttagttgcttctcaccgtccttaggatggagtccgaacttcttatcacggttcataagcctctcatgatcagtaacttgccatcagtctgaactccactcacactgacctctagtgtttcaaacataccctgcttccttttgcctctaggccttcacagatgctgtttcctctgctcggagtgttctactgtagggcctctaacatctgtagactaaattctagcctcaaattatcagttatcttattcctgaatcagaactgaactgggattcttaatattttttttattaattcttgaattaaagccaggatttatattatcctatatatttctttgaaaaatgcaaagatattttctaatgaaactgtatttgaactaattaacttagggttcagtttttaaaaatcatagctgaatgtaaactggaacgtattttttttcatggtactggaatgttttcttggttgttattcatcatgacattctagctttggaatttttcatttccagctgacttctagcagtctcctttcttacctctcaaccccttacactctggttgccctatacttgcccctagatggatccagtttgcatgcagtggtagttgctgtgaggctgcggttaaatagagctgctcagactgcaacaggaaagcattgaatcgaaagcaaaggggaggaagcacaaaccgatacccaccacaaagctgctgagtgcccagcatgacccaagccgcaccctctgatgaggagtcttgtggaggagtaagaagccacagactttaataaaccatcagcacagcctgtcctccacttccctggtccagccttcccggatcaccatgagtatcaccgggtactgacctaagaagctgggtgatgacagaaaagtgaccagaaatgtagagtccagaggaaggtacccgaaatgaatgactgtagaccattttatctcaaactccctacacagtcaagcgtggtgagcacgaaggtccggggcatgagaatgtttctgaggagctccctgcttggggtgattcccagatgaagactcctaaaaatgttccctaaaaatgcctttgctacctccctgaaaggctgcttctagtagtggccaaaacaacttataaaaattttgtaactaaaaataaagcccttgcgagatacagttaagagaactttaaacatacactaaggtatgatgactatttttagattcctgacttcaatggagggaggagaaaggaaggagatggagcagcaaagacatatgttacctacttgattttgctcatggcctaccctgtttacatctgtcccttttgctatcaaaggagatattaaggaattataggaaagggaatgaaaagtgtggaaaaatatataggaactaagtacagattttaaacaccggtaaggtggagaactccttggaaatctagagcttcacagtggctctataattcacctgttcaggttcactacctcagaatctaagaaggtgagatctgggccctacttttgcagctggaaggtcagaacacaaagaatggaggtgactgactcagtctggaggaaaggttgcttggcttggctggaagtgggcacttgtgtcatcatagagtgccaacctcacacttcagataacagaacaggaaatattgttagttcagatgggagagcagaggactgactgtgtatccaagaccattaagttattcagtcacctctttgtgttgtactttctatcctacaagggaccagagctggctgtggggagcttgggcaatagatgaagcaggccatcaggccagtccctgttccttgcagctttcttctcccttctatcacgttcagcttctttaatctgctcaacccagaaagtcttccaagattgacatcattaccaaagtttaaatggaagaatctgaggcattttgataggagacaggggtgacaattctggagtagaggaactgtctctcacaaggcctctctactacaagtggtaaaaatttgtgctttattttaacaaccacaacaacagtgaattggaagggatctaataacagaacagaatttgtagtcagacaactttgttttgaaactattcttcctttcttcccttcctccctccctcccttccttctttccttccttcctttccttcggaaaggaaaggacagggaggatagccatagaatgggaagctccttagacctcagaggaatgccgcaagcttcccaagtctgagtgcctgcccagagtttgcctactttcttcagtagtcaaggatattcctcaagttgtgtttaatatctatgcatgagccaaactgtggtaggtgggtgactgcattccccaggtgcaatctttcagcatgtgacctgatgtagtacattacattccttagacaaggaaaaaatagcgatatgaatgcaaagagggggaggcagagagtgtaagctactctaaaacacttagttatgaaagaagaaagattggctagaaagcatgtgtaataaggaatgaattccatttttttaattgagagaggttcaggaatgtttatatacttgaggaaaaagcatagtgagagatcttaacaagtcacttcattcctaagctttgatacccccatccgaggtgaggaggagaggagaggagtttctataaagattaaaattgaattaaaatcatatgcacagtagtggcttatatgccacaaagccctttacacatgttaatttttataactattatcatctagtgactgtacagatgagtaagccctggtcacagctgttctatattttctaccctatatgacagagctgtcaagaggagacaggctcttgagtaggcagggctaagacacataaataagaggctaacattggtgtgatttgtatcttgacatgctttgagcttttggaggatggtgtgtgtatgtgtctgacttactagacacaatgagttaccatttatttcaacttgccctgtattcttattttaaaaatcttacttaaaacatggacacatgtcaaatccaacatgtctctaaaaagagctaatgtttggagaaaattttagaaatattcacaaactatgcatctgataaaggtctattcagaatctataaggaacttaaacaattcaacaagcaaaaaataaccccattaacaagcgggcaggccaggtgcagtggctcacacctgtaatcccagcactgtggaaggctaaggcaggcagactacttgaggtccggagttcaagaccagcctggccaagatggtgaaacctcccctactaaaaatacaaaaattagccaggtgtggtggtgcacacttgtaatcccagatactcgggaggttgaggcaggagaatcgcttgaactcggaaggtggagactacagtgagccgagatggtgccactgcgttccagcctgggcgacaaagtaagactccgtctcaaaaataaataaataaataaatagaatacatttaaaaagttggaaaaggacatgaacagatacttttcaaaagaagtcatacaaacagacaacaaacgtggaaaaatactcaacatcactaatcattagagaaatgcaaatcaaaaccacggtgagataccatctcacaccaatcagaatggctattattaaaaagtcaggccgggctcagtgcctcacacctgtaatcccagcactttgggaggccgaggaggatggatcacctaaggtcaggagtctgagaccaacttggccaacatggtggaaccctgtttctgctaaaaatacaaaaattagccgggtatggtggcacatgcctgtaatcccagctactcaggaggctgaggcaggagaatttcttgaacccgggtggcagaggttacattgagccaagatcgcaccattgcactcgagtctgggtgatagagcaagactctgtctcaaaaaaaaaaaaaaaaaaaaaaaatagtcaaaagccacagttgctggcgaggctaccaagaaaagggaatgcttatctattgtcggtgtgaatgtaaattagttcagctactgtggaaaagtagtttggtgatttctcaaagaacttaaaacaaaattaccgttcaacccagcaatcttcattactgagtatatatctaaaggaaaataaaccattctaccaaaaagacacatgcactcacatgttcatcacagcactattcacaatagcaaagacatggaatcaatctaggtgttcatcaacagtggattggattttttaaaatagggtatatacatagcatggtataatacacagtcaaaaaaatgagtgaaatcatatcctttgtagcaacatggatggagctagaggtcattatcctgagtgaattaaggcagaaacagaaaaccaaatgtgttagtaagatctcacaagtgggagttaagcattgggtactcatggacataaagatgacaacaataggtactggggactactagaggcaggaaggaggaagggggacaaagcttgaaatacttacctattggtcactatgctcattatctaggtgaggggatcattcacaccccaaacctcagtgttatgccatatacccatgtaacaaacctgcacatgtactcctgagtctaaaataaaagttaaaattattttttaaaataaataaataggtcgggcgtggtggctcacacctataatcccagcactttgggaggctgaggcgggtggatcacttgaggttaggagttcaagaccagcctgaccaacatggtgaaaccccatctctgaaaaatacaaaattaactgggcgtggtggcatgctcctgtaatcccagctacttgggaagctgaggcaggagaattgcttgaacccaggaggcagaggttgcagtgagctgagatcgagccattacactccagcctgggcaacgagagtgaaactccatctcaaaaaaaaaaaaaattaaaattaaaaaataaataaataaacaaaattaaaagttgccatgttgaaaaacactaatccatcttgagatgcaaggatctgtacaaataagactatatacatgaacttcaggttacataaaggagcagtttctgtttgtaggtggggggagtaaactttttgtgtttctttctggctcattgcaggatcacattataattttgctttgatacaaatttggcaacaggaatcataattctttttccaactgactacagtgcttgtatacttttaacgaataatcgctgtgagttgtacaaagccttatatattcaacaaatcagtgaagtttttatcctcttaatatttactttgtagctttgctttgaaccacctcagccccagttctacacagttggcagtaaagatatctgcaaattccactcccccatttcctttctgttttgcccttggtttttcaacagtgagatgattgtgccttcatttctgggtgcatcccttcacttattccttatttcccttctccatcccttactccttccttctcttccccaggccttcacaacctctagattttattactagcaacttcttaggccaatcccatagcatgctccttcatgcattacatgaacaaattttttgagggtgctgaaccaaacaatcaggtgtcttttttcaagagtgaacaagaagccactttttaaaaacagttttactgagatataatttgtattctataaaattcgcatttaaagtgtacaattcaatggttttcagtatatctatttagcagggcacccgtcaccataattaattttagaatattttcatcatctccaaaagaaaccttatattcattagcagtcactcatcaattctattctcccataccccacccctttattccctctagtcctagacaaacactaatctgctttctgtttctatggatttgcctattctggacattttatataaatgagatcatataatatgtggtcttttgtgactggcttccttcacttagcagaatgtttttgaggttcatctatattgtggcatctatctgtacctcattcctttttattgccaaataatatttcattgtatggatatttcacattttgtttatctgttcatcagttgatgacaaatgggttgtttctactttttggttattgtgaataaagtttctgtgaatatttgtgcacaagtttttgtatggaaatatgttttcattgcttttgggtagattcccaagataaaagaattgctgggtcatatggtaactctatttttagcatttagagggactgtcaaacttttccaatgtggctacaccattttactttcccactagcagtgtatgagctttccaatttctccacatccttaccaacaattattattttctgcctatattattatagccattccagtgggtgaaaattgatatctcattgtgcttttgatttatattttcctagtgacttttcatgtgcttatttgcatatttttctcttgaaaaatatcttgtaatcctttgcccattcccaacttagatcatttgtcatttcttattgatttgtgttttttatattctagtcccttaacagatagtataatttgcaaatatgctctctgattctgtggggctgttctttcacttgttggtgtcctttgaagcacagaagtttttcattttgattaagttcaacttatcaactttttttctcttttattatttgtgctcttgatgttgcatcaaagaaattactgcctaactcaaagtcacaaagatttactgcttaactcaggtcaaaagagttagttttcttctaaaagttttatatctcagcttcttttttttttttttttcattttttccatttttatttgatgtttccaaatataaaaaagtcaggattcttacatcaattatctcaaatgagaccatgcaaagcaattcagtgtatacaacaatcatttttccccttcagttctgctgctttatacaacagtgtgattgacagaaaattggatggcatgtgcctggtcagaaaatgtcatctgtttacaaaataacatcatgcagcacagtttctactttgtctgcaagtcaattcacaaaaactacttattttctgttttttatttgggaggcacatggaactgaaaaatttagctgcccaattttattcaactaccccaccaaaaaaaaaaaaaaaaaaaaatcacaaatgacagtcccaacactctgcaaattttggagggttgagatagtagacactatttgtcatactcagcagagttaactatttaacagaaataaatctccctagggcctttcctctcattttgctagactgggttccaggagaatcgtgaagaacccctcatgtaaaatttgaagtgtgaaaactgtgttgttgcattatgcagatttttgctagttgcatagactaaagacgttttgctaaatggcactgaaaatccttaccgagtgtcactattcagtccaagtgtttctgaccaaagaaaattatacaacaatatttataggctaactttaaagagatggttgacgttaatactgtacatattttacatgtcaaatacatagtccaagagtttataaaataaattcatgcatcattaccttattacctctaagaatatcatgtacaagatgggcactcccccacccccccagtacttatgacagcatttcaggtggaagcagtcttatatacaaaaacaatccagtttctctgctatgttaagtatataatttaaggaaatttcagagattactgaccaaaaaaatcttagtccattgaagatagaaagtgtcaatttgtgggatttaaaatgtttcctttataaaagaacacccagaatatgtaacctctgtacaaagaaaaaaatatacaaattctggatgatcatgtttgatcacactacgtacttgaaatgttgctggttaaaagttcttctgctttactcattcctttgacagcattaatttgtgaacatttatattcagttcagctgtatttatggcacaagatctcatttccaaaatggcactaattttccttaagtgtaacagcactctatttttagcagtaattatatttttaaaggttaatttgtagaacaaatgttttaactatactttttttctactctatactccccagttacaatatttacaaagggctgaagtctatataaaaaaatgatctttggctgggcatggtggctcatgcctgtaatcccagcactttgggaggtcgaggcaggaggatcacgaggttaggagtttgagaccagcctgaccaacatgaagaaaccctgcctctactaaaaatacaaaattagccaggcatggaggcaggctcctgtaatcccaactactcgggaggctgaggcaggagaatcgcttgaacccgggaggcggaggttgcggtgagttgagattgtgccattgcactccagcctgggtgacaaagcgagtctcaaaaaaaaaaaaagacatcttttactttcccccatccctcattttagtcaaacttctcccacctcatttctgccctggttggggaagtgcaagagtttcagataaggtacctatgtgttttagatgggattcttgattttaagtgagtataaagtaaaagatttaattcttagttcaggtatgttccagtgcctcgaaagttagttatgtgacaaatagtacctgttgacaacctagaaaagatgagacattctaaggtgccctaacaatcttcagtctctaacagctgaacaggaaggccatttcactcaactgtgatgcgatcatcactgactggcatttagaattagatttcaagactccactcctgtgggggccactaaataactgaatacattttaagagcaatctacactgagggaaataacggttctaaggtattctgcatagaaagagtatcgataatgggaactggcaactgagcatgctaaatcaaattccatgaatagagttttcataagatgtctttactacatgcattttgctaatatttccctaaaatattcaccaactctacagagttatactttgtgttaaggtactattgagttataagggaaatagccatatcaggtagctagtgacataataccagttgtgaaaattcagacaaaatgagtcgacaaatccccaaaaatggcaaattaagccctgtgacaaaataagttattggatcatacagaaatagcccaaatctggaaattttgaattaaaattgtaatcctgtaaaacaagttttggggtgaatggatttctttaataccaataatatttttaattcccaccacagatggatttgctgaatatgctaatgctgtgaatgagaaaacaattttggggtaggtatacccacaagtaatctgatgacaaaataaaccacagactgatgtcaaatggacaaaaaactgaaaatatgctgtgagaaatagacaaccaaaataatatagggggttgtggggtgtggcacagttaaggcatctaaacaaaaattccacatggctttggcttattaaaatattttacactatttttttaaaaaaagatttgaaagcatctgaaaaacatgcaaattgtttgaaaaccttgcatggcaaattcagacagtttgcaagcgtcaatcagatgtttgacgaggaaacgaaagaagcctctccccatgagactgcacatggtgggagaggcctacccagttctctctatcttacactagatggcaacccagaggtctgtgcagcggttacaaacaaggcattattatccgaagggaagggactgtagaatttccattggctggggaacaacccagctttagcttttccagatactctgcatgtacaggtttatgacactggagaactttgatagcatcttctactttgaaccactctctcttccttccaatattaacagaatcttcccaatcttctaatatttcagtgactgttagaacataaacatatgttctgtgctttcggtcttggttctgctcaaatatgcccagaagtctgcctagttttcctttgactccagcctcctcataaacttccctcacggcagcaccgccaggttcctcctcgggttccattcctcctcctgggacaatccactggtctgggtaccggctgctactcaccagcagcacctcgtcctcctgctcgctccggaagcacaggcacgccgcccgcttcttgaagccctcgcggtcgtaggtccgcgtctggttgggcttgaacttcatcatagaggcgggctcctgctgctgctgctgctgctccggccgccgccaccccgccggggagtgggggcgagggcgagtcgggcgcaggagcgcctgggagcgctagtcggtgcgggaggtgcggcgaggccggtcagtcccggggccggcggccgctccgacgcgggcgggacgggacgctagcgcgggtcactggaaccagggtgccgagatgaaagctccgcctctgcccagttgtccgccgctctccatggagcccgactcccgctcgcctccgctccctccggccgtagccgccaggggaagggcggctagaggcgcgcgccacgcggagacagttgcgaagacccgctcccactgagcagcagcaccacggcgactgtattttagcttctacatttaggcctatgattcactttgagttaattattgtgtacaatcttaggggtccaaattaattcttttgcgtgtggatatccagttgcccagcaccacttgttgaaaagaccattttttttttcccccattgaattgtcttggctctttcgttgaaaatcaattgattgtaactgttagggtttatttgtgattctcaattctgttccattgatctgtatgtttatccttctgtcagtaacacactgtctttgttactgtagttttgttgtaagttttgaaattgggaagtgtgaatccaccaactttgttcttcattgttttggcttttatgagtcccatgcatttccatatacattttaagagcagcagaaattgacaagttgattctaaaattcattaaaaaccctcacttctaagaaacaattaaaatattttctttccaacctaggatgaaattggataaggaggactgagcaggtacatttttgagttgtggtgatgggggatgggtcatttgaaagggggaccaacctgatggaggaggggaataaaggagccacaaagtttggtaaacttcccaccctggtgagaggaatgtttgttcagaggaggcagtttgttctaacaccagggaatattatgaaagataattgaaattgtaaagtccattgatatctccccagaagacaaaaaggtctctaagtaagcagtattgttagcttgttgattcttacagaagaagattttcatccaactaagggaagcagctgggactttctcagggctgtaagacagaaaaaaaatgaagaaatccctctgtatcttttcttacctctccctgtggccagccctaacttttgtccatttttgttacccttcccttttataagctccccaaaaagagagagaggagaaagagaaaaagaagaaaaccacagtgggagagagggttagagatcctggggatgggggaggaattctggagcatttcaaattaaagatccctaaggtactatgggtggaacctactaagtaatatgacaacttgtagcaagagtcataaggatgatcacatcttcaactcagtgatccaattcctgggaatttatgtaaggaaataagacaggcaaaaagtgtgagtgggaatgttaatgaaaatattacctataatagtgcaaacaggaacaacctaaatcaccaaaatagaagcatgttttatgacgtcatggcatgtaaagatggcagattataatactagcttcactgtcaaaatatactctgaattgcatcacttttcactgcattctgtatcactctggatcaagtcactattattcctcatctgaattattgcaatggcctcccaactggcatttctgctttcacccttgttccccacccccagtctactctcaacacagcacccttagcagtcctttaaaaacttaaatgtaaaattcatatggaatcataaaagggcctaaatagccaaagcaatcctaagcaaaaagaacaaatctggaggcatcacattacccaacttcaaattatactacaaggttatagtaatcgaaacagcatggtactgatataaaagtagatgcatagaccagtggaacagactagagaacctggaagtaaagccagatacttagaaccaactgatcttcaacaaagcatacaaaaacataaattgggaaaaggacaccctatttagtaaatggttctgtgaaaactggagagccactggatagaagaatgaaactggatccatctctctcaccacatacaaaaatcaccctaagatggaataaagacttaaatataagacctgaaaccataacaattctagaagaaaacataggaaaaattcttctggactttggcctaggcacaaaattatgactaagaccccaaaagcaaatgcaacaaaaatttaaacaaataaacggaacccgattaaactaaaaggcttttgtgcagcaaaatatataatcatcagagtaaagagaaaacccacagaatgggagaagatatttgcaagtatccatctaagaaaggactaatatccaggatctacaaggagctcaaacaaatcagcaggaaaaaaaaaaaacaaataattccattaaaaagtgggcaatttacatgaatagatgcttctcaaaagaaggtacacaaatggccaataaacatggaaaaaatttcaacatcactgaacatcagggaaatgcaaatcaaagccacagtgagataccactttaccccaaccagaatggccattgttaaaaatccaaaaagcgatagatgttgtcacagatggggtgaaaagggaacacttatacactgctagtgggaatgtaagttaatataacatctatggaaaacagtatgacgatttctcaaagaactaaaagtagcaatcccactgttgggtatctacccaaaggaaaataagtcattatatcagaaaggaaaataaatcattatatctgcacatgtatgtttatcgcagcacaattgacaatggcaaaggtatagaactaacctaagagctcatcaaccaattagtggataaagaaaatgtggtatatacatgccatggaatactactcagccacaaaaaagaatgaaataatgtcttgcactacttggatggagctggaggccattattttaagtgaaataactcaggaatggaaaaccaaatgccatatgttctcacttataagtgggagttaagttatgggtacacaaaggcttacaaagtggtataatggacatttgagattcagacaggggaaggttgggaggaaggtgagggataaaaaactgcatattgggtacaatgtatactacttgggtgacaggggtactaaaatatcagacttcaccactatacagttcatccatgtaaccaaacaccacttatacccttaaagttattgaaataaaaatgtatttaaaatttaaaaaagaaaacctaaatgtgtcatccactactcaaaagtttccatggctccttctcatttagtataaaagccaatgtctttgattagtcctgggccctacctcatctggcctccatctgtgacttcatctgatatttttcttcctgtaactccattctgaacatataggcctcctaactgtttcttgaatataacaggcctcctcctgccccagtgacttttgactcttccctctgcctcagagtctcttctcccagatatccattagtttgttccttcactgccttcagatctttgttcaaatgtaaccaatgatactttcttttcctgacaatcgtatttaaacttgctatcttcctcccatccctcagcctctagcatatcctgttcttccttgctttattcttccaacgcttatcattttacctgacttatttttctgggctgttgtctattcctccccctgtaacccatgctctatgagagcaaggatttatgtattttgctcactactatatcctcagtgtcttgactattcctggcacagagtagctgcttaataaataatttactgaatgagtgaatacatccacaaaaggagtgattatgaaaattgggtcataatttgaaaagtggaaagtacgttactgtaagctgtgatgtgcacagtggctgtggcaatgtggtgtagcatagtctgggagctgcagatgagagagatctggatttgaatcctgagtccactacttcctagttatgtgaacttcggcaagtgtacctaacctctcagttttatcatctgtggaacaggtagaataatacctccttcatagcatggtgaaaattaaatgagaagatgtaggaagaacctggcacataataggtgttctatgaacattaactctctctcttctcctaaagaatatatacacagtgggtaagaattgcaaaataattgggtgtttcaaagacagggatgatgcacttttataaaaaaattttaatacacaagtcctctctaagcatggatatatatataaaaacagtgccagactaggagtatggagacctgggttctgggttcacctctgatgcaggctgtgtgacattaagcaaatcctaacctcttgggactgtcttttcatctgcaaaatgaagaggtagaatttagtaagtttgagtcccatcaatgcttaaaattctataattcagaaaggcaggccattctacctagtttcatcccgctttagctcagccttactcagatatgctggccagatgtttctaatcttacacataaaagactctggtattcagaggccaaaagaaactggacaatttaagaaaagtactaagcagatgagttttccttctgtctgattcttaaacagctacatgacaattattcaaacttaagaaaacaggaaaagaaaagcaagtatgcacatttaggtttgaatcaactatgtgaatatttagccatgaagaaaaatgtgtttttttgtgtgtgttttattaattattatttgtacaacaaccaaaaagtagacgtcagcagttttcaactgtaactataaccttgtaccatgtggctgtgggccgaagtgcaggagggagtagctggaagggaatctggctagagccttcccctgctctggaaagctcgtggctttgtttttttcacattgctacaccgagacggaggaggggaggatgtttgggtttacaggccaccagccactgtcagcaagtttgtagccccagcttcacttccctgaaagggcgggggagtttcagctgccctggcctccctccagcaactgagccacagaggattcaaataccccatcagttgcaaggccctgactttacccagctgaaaactgactatctcatctgggaagggtcagttaaaaaatgacagaactgcctaaagtaaacaaagggaacaaccacaacagaaactttctctgcagtgtttccttataattaccggcccatcccaccagggctctggcttgagtccccatccactctccctgttgcccccacaggaccttgtttgagtaagccctagctgacctgaggatcgcctccctgtctacatgcctctgtcccaccctctccatggaggggagggagactcccgattgcaggaagttttgagaatggagtttgaggattgtcaggcaaaaagaccctctagagctcattcattaggacccctaatagatgagtaaacagcttaaatgaagtgcctaaagttgagagcaagtatgggacagaactggttttcttcttgctaaccgagtgctctttccagtaatcatatactgttgtaaggcactaaagataaggaaactaacattgaagttctttctccaccttttcattctaaccaaatcctactttgttggacttttacactttatagataggctgggcatggtagctcacacctgtaatcccagcactttgggaggtcgaggtaggtggatcataatgtcaggagttcaagaacagccttgccaatatggtgaaaccccatctctactaaaaataaaaacaaaaaaaaaattagctgggtgtggtggcgggcgcctgtaatcccagctactcaggaggctgaggcagagaattgcttgaacccggcaggcggatgttgcagtgagctgagatcatgccactgcactccagcctggctgacacagcgagactcaatctcaaaaaaaacaaaaacaaaaacagaaaaacacgctttatagataaacatattttgaatttagacttaaggacaaggactaaatcttacactctgtgtaccttgttcgtacttcagagttcatgaagtgtgttcatggtcagcagccaagtagagcgggtaggacatttgcttcagagttgagcaagcctcagaatcccatctctgcacattctagctgtgtaaacttgtaggcagattacctactctaaaacttagtttccacatttgcaaaaggggaacaataatagctccacctcattattttgtcatgaggatttcatggatgatacatgtaatgcacattgaaaaactcaacaaatgttagaaatggtaaatagttctggaaggcatttatcattcccattttacagatgagaaaattaaagctcagagagtttaagggctagagtcatacaattggttagtaagatagctaggatttagctcagcctcccagctccatatccacagtacttgctgccccaccattgagtgtagacaattgggggtggctctaagccatgggccaaatatgtctgtccctatcatcatggaatgacatgttatttattaagcccatatatgcttgaggtgccaggaaatggatgcttctggggtgaggtaggctcttcatgtgcagccttcatgtacagattccagccaaggaaaccaagcctggcactaatcccttgtccaagcccagagacgctgtgcccacggagtaggtcagaagtccttgaatatcctcagctttcctttcctctggcaatgcttccttgatgccctaagaatattttgcttaccctgacattagagccctcttcacactcccaagctttctagtattttgggtgtgcatctgattctcctgttgaaactggactccaaagtgaagtgctcaaaatggtacatagaggtatgagaaaaacatatgtgaatacttgcttctatttattttttaatctaaaatattaagaaaattaggctttactaatattaaaatgtcacagtagagtgtatggaatttatagcaaacatgcaattattaggcatgtatgctggttttcttttctttctttctttctttctttctttttttttttgatggagtggtatgaagaaaagagactagaggtaactgttctagaaagtaaggtcctacaggcagaagatgtgtctttttctaatgtgtattccacccctccctcattagcactaaatgactcctccctgattaaataaatttggcatctatgtaaacttggtggtctttcttgtttttcccctccttttgtcatccatctgatataatgtcttattcaatattctcccaagacctgaacaaataataaagctgtgttagtaaagagtgcaaattgccataaaaagactgaaaagtaagattcatagtccccaaggagatggttaatggtagtcaataaggcatatagcgggcaaaagaaaagctaaatgtaaaacttcatggaagaactcatggacacagtcaggcagggagccccagcactacagcctgagaaatcaaatgtaatctgagcatatgtgtgttttcaaactaaccactgccctctctctcctctgaaacttgcagaaagcaatgcaacacaatgcaatgagccagggtcttggagaaagaaagaaatcccaactctgtcactgtcctggttgggtgatcttgggcaaggtccataatcacccccactcccaggaaaaatagttcttcacctacaaatgaggttgagctaggtgattttggaggttactttcatgctttgaagcagcccatgttttcttcctgaggcaatttatacttcaagtgacaccatgaagctcactggaccaaaaatatcaccttaccaccaagcctttcatggtttgtgacatcctctcctcaggcaccgtgtctccatgcggtgcttcccaacctagcaataacttactggcatgaatccacttcaagtatcagttatgtccatgatgcatgtagagtgggaaagcaagatatgaaaggttatatatgtggtatgcgtatgtctataaatacctacaaatatatgtgcatacacatagaaaaagaactgaaagatactcagcatactttcaacactgattattcctagggagtaggaaagcaagatgaaggtatgaattttaccatttactttaaatcctcctatatttttgttgttttttaaaaataaatgattttactatttacaaataaaaattttaaaaaataaacattaaagtcctatacaaatgtttaataatatttgtaataagtagcaccagtttcttcaagaagccctaccagaagcaaatctgcatcttgatactgcattagagccttggctgaagtactaataatacccgaacattctatggaggattgggccctggactgggagaacctaatcacataatcagaaactcttattgagtaattttgggcaacttgagttttcccaaactttacttgagtttgtttttctcgactagaaaacaatgcttttgaactaaatcctctatcgggaactttctactctgaagtcctgtgattcttaacaacagtacatgcaaaagacacaggaaagtgagtatgtcatatggcatccaggatactttcccccaaagcaaagtgaaaactgatgtgaaactccttcttccttccttattttcctctctctctctctctccacctctgttatctaaatgctctatatttgaagcattcatcactttataggccttgatgggatacagaggacaaccttttactttagaagctgaaaatgtcagatacttgttttccagcttcccttacaggtatgcataggcataaggatctgcattgctttttgactcaggagctagtgacctcaaatagcaaagactgttgaatctgttctgcagcagggagtggcattagttgtaataacaacattcattttttagatgctacagtggtggtggttctggtggttctagcagcagggaccagcatccaggcttggggcattcactgagcagtggtttccatgcagtgggggcattgatgacttcatgatattgttctgcagtacaattttaggtgttgcttctggctatgtagcctctaaacctgggtttctagtcctcctggagagcttgtgaactacctaatattttttaataaattcatttaccgcttagattaactacaaattgtttctgttgcttgcgaccgaaaacatttactaatgtacctattatttttttaaaaaatcatgcacttggagattatatatatatacacacacatatgtttttaagggaaaaaaactccccttccctttgttgatcccttattttcccagtttcttctctggaggtagtaataatgatttgtttcttatgtattcctccagagatatcttgtgtgtacacaagcacatctatgtatttaagaaaagttacttaaaaatcactcaaataggatcactccatatacactgttccataatttgcttgtaaccttaagactacatgttagagataattccataaatataaagctgcctcattctttttcttatttttatttttagagacaggtcttgctctgtctcccacgctagagtgctgtggtgtgattatagctcactgcaacctctaactcctgagctcaggggatcctcctgcttcagcctcccaagtagttgggacaacaggtacgtgccaccactcctcgctaattttttattttttgtagagtcaggccttgccatgttgcccgggctggtctcgaactcctggcctcaactgatcttcccatcttggtctctcaaagtgctgggattacaagtgtgagtgactgtgcctggcctgcctcattctttttattggctgcttaatatccctctgaatgaatatactgtaatttatgtagccaatttcctcctgtaagcagttgggttgcttacagtttttgtgactacaaataatgctgcagtgaatatcgttgtaaatatgtatttttaaaaaaatatggaatgcttcatgcatgtcatccttgtgcaggggccatgacaatcttctctgtatccttccaattttagcatatgtgcagctgaagtgagcaagtaaatatgtcttaatgcccagtgcaagcagatacatgtctgatagggaagttgcagcgtcaaaaggtaaatgtaactttaacattttgatagatagcaccaaaatgcactgcaaatttagtaacaatttttaatcctactaaaaatattttagactcccccccaccaaatctttacgtcaccagtgtatattatcagattttataattttgctgttctaataggtgaaaactgattttctcattgttctgattttcattctttaatttatgagtgaggttgaacatttttcatgtatttaaaagccatttgtaagtattcacctgtgtagtatattcatgtcctttgcctgttgttttctattggatttttatctgtgtttaattgctttgtaaaaacttcatctttttttttttttttttttgaaataggttcttgctttgtcacccagactggagttgcagtctggcaccctcctgacttggcctttttttttttttttttttgagacaaagtctcactctgttgcctgggctggagtgcagtggcgcaatctcagctcacttcaaccttcgcctcccaggttcgagtgattctcctgcctcggtctcccaagtagctgggattacaggcatgtgctaccactcccggctaattgttttgtatttttcgtagagatggggtttcaccatgttggccagactggtcttgaactcctgacctcaagtgatctgcctgcctcggccccccacagcacccagccctgcctcagccttttaaagtgctaggatgacaagtgtgagccactacacctggtcaaaattccatattttaaagtaaatttgccttttgtcatacttgttgcaaaattttttcccaatttgtttttggttttctgatctttttaaatttgatctgatttttggtttttgctttgcataaatctttaattttcacaaagccaaatttgtctatatttttgcttatggctctggatttgtttggaatggcttttggctgggtagcttctcatggtttcaacattgaagctgctaatttagaaaaacaatacttgagacttctggttaaagacagcagattaaacacatgctccactccctcctagaactcaaccaaaatttaatgttttgattaagtgatacattcacatggttttaaaaccagaaaaatacaaagatgcacagcctgaaacgtttccctcatctatgtctcccatcagctcagtttccactttctccctgtccagaaataaggactgttatgctttcttatgcgtgtttccagagtttctttatgcatatgtaagcaagtaagaattttggtgagttttttttaaggagaaacctacaaggacaaaagaatataaaaaggacaagagtaagaaagataattttaaaagctggaacataaggccgggcacaatggctcacgcctataatcccagcactttgggaggctgaggcaggtggatcacttgaggtcaggagttcaagaccagcctggccaacatggtaaaaacccatctcaactaaaaaaacaaaaattagccgggcatggtggcgggtgcctgtagtctcagctacttgggaggctgaggcaggagaatcacttgaaccgggaaggtcgggggtgggggttgcagttagccgagattgcaccactgtactccagcctgggtgacagagtgagactgcgtctcaaaaaataaataaataaacaaataaaagctagaacatagatgaatgagtggtaactgaatcaagagacctgagaaagctgaatcctaagcctgcagatgagaaaggtaaagcaactcactttacatttcagaatcccccaaatgctcagcaattggtggcaccaggtacttttggaaataagggtgaagttgtggctaaaaacagtaagttgcattgaaaatcagttcaggaaacaatgaaagctccaggccccctcttcctcttgctgttagatggattgccccttccccacgatgtccaagaatggaggtttttctggtgggagagtaagacagagaagggacaaggcactattgtgtgaaaggacaacatgctgggaaaaaacaggagattataagcccattgccttctgccatcttctcttacttaggaaaccctgacagccagcctgaatattaggaaagccttctctgaaaccctgacacactggagagaaatgctccaaagataactcagaaatgacagcatctctgaaagaaaaagaaaacaagaagtattaataatatctccagagaaataagagaactagtgcatatatgaaataagaacagaatgctatgttttaaaaggaacattcagagaacaaaaaaaacttagaaatttaaatatgatagcaaaaatataaaaaagcttagtagatttggaaagtagaaaggaaagcagaaagataacagatagaaaataaaaaatatggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaagaaaataaaaaatataagagcaaaattagtttatttgggagatgaccccagtaaacatctgtacgggagtaaagtaacgagaaaaggatcctacggaagttaatatatcttgcaagttactgtgaaccagtggaacttgactccatcggggaactctgggagacctgtgtagaaagcatgcttcagggttaaaccgcctcatggttgagcaagctgggatatttatctactaactctcatcagtcattggttaagggtctctcccagggaaaagggggttaattccccagcacttcctgagcaaactttcagtagctagaaaaagccctcaggcaaacagacatatgtgctggcagttttgaaggcctggatgttaagtgccaagagaatttgggcagggcactgatggcaaatgttatatcttccctgcactctctcttaggaaactactgaagaatgtgctccaccaaaacagtgttgtgagtcaagaaagaggaagaggcggaattcaggaaccagagcactcaacacagaggtgaagagagtccccaggatgtgggtaaagggaagtcccaagatgacagatgcacagcaggcctagaggtcagttagcccagagaggagcagatcagtaggctctggaagagctctcttccagatgaaactgatggaataccaagtttgtttggacatattgagaggagacttaaacaactacagaggagtatggattaaattagtggcatatgcatagaaaaactaggcaaatgaaaaatgagacaattattaactccagagaaagcaaaatagttttgaagaaagtgatcataatttattatgcaacacaggtgtgaatagtatttatttgatcatagtaatataaacactgagtgtcagtttaatagtgacgtagaaatataggcccatgtggtataggaagaggcgaaaactgaatccccatcttccacagtggaaagtcaatagagaaaactaagaggtagctatttagagatacaatgatttccctcctccccctaaaaaaagatttagtgaaagcattgaaagtgatttcctctgaggagtgggaaatgaaggggtggagtaggggaatgctgtttcttgtaattagtaatttagaaatatttgattctttaaactatgtgcatatttaactttgatgtttaaaaaaactaaataaaactcagtaatttttttcctttgctgtatgaaaaagggaggaggtgagatggaaaatgtacctcattcctagctgataagaaaactgggcaggcaaaatgaaacttgcttgttccatgagtccatcaacccagcagggtcaatgtcttttccatcttcttcagtcagaagaaaagctatgagcaactgggaaatcaaaactgaaattcctttgaaagagccattgatgccaaactgacctgaaatctggggctaccctaagagggctttggcctaaataaatggtccagggtaagtacaaagaaaggattctatcaaatgcaaaaatgagaccaggattatattaagggagctagtaacagcacttgagtgcaagtagaatacattcttaattatgtctaatatgaatttctttaaattctttaaaagccagttgttttaaaatacagaaattaaaaatattactatattgatttatagttttaattttaaaaaccatgggagtactttgtacagtcttttaattaaccgtatctatgactgaaattgcacatcgtttaggtctctggcccgatcatgataccagagtctgttactttctgattgcaggcaaaataactacaggaatgaggcctcctgaaggcagaatcagttctcctttctcttcctgccttcaatctttacctactagatccttctcctcagcctagaaaaatgcccaaaaagttccaatctaaaataaaaataaagaaggaattctcacttaagctatcacccaaactttctcttttccttcatcataatacttctaaaaaaatatgctaacttccttttcttcctttacttcctcaccacatactacttcttaactccttgtaatctagctttcactttgaccgttgcactgaacctgctgtctcagaggtctcaaaggacttcttacttgctaaatttcggtcctgcttagccctcatcctcctcaacctctctgtttttgactttcaaaatgtctcactgtgtctctctctgttgctctgtctctctctcttctctctgtctctctcacccacccaccctctagcccccttattctgtgttattcctctcttttggttttctctcctcccttattattcttcctttgagtcttctgtcccgctcattctcttaagaataggcatccaatgagatcccatgactccctgcaatatctgggatctgcctatgtctccaaactcatatgcaccctgttcccccttgttcatttcactccagtcacactgatgtttcagttcctctaatgggccaatgagctctttattaccttaggacctgctctctctacctgggacactcttccccatgttcccccacacccaaagcgcttcatctggctatttccaaatcaactttcaggtctcagcttcatattacttcctcagagtggctctccctaagtgcatcccctccccacccctccaaattaaatctgtttccccattttttctattttagaaatagtttttttatcaaattattatatggtttaaaatgaaagactacttgtgtgtttatttgcttaaatctctacctttctctccagagtgtaatttccatgaggacaggaaccatgtcagttttgtttaacactgtatccttagcattcaacacagaccttgaagcagcagacaacaaatattggttgaataaatgagtgaacaaagtgccaggcactacagtaagtacttcttcctgccaggcgctatggcaagtactttacatatatcacctcgtttttattcttaccacaaccctatgcataggtactactatcagatgaggaaatggaagcttacagagacagaccaatatgcccaaaatctcacagaaaaatgaatgtagctatcacgacgtgaaaagatgtagaggaaccttaactgcagattattaagttaaagaagctaatctaaaaagccttcatactgtatgattccaactatgtgacattctggaaacagcagaactatagagacagtagaaaggtcaatagttgctgggggttgtcctcgggagggatgaagaggcagagcacagaggattttaaggaacgaaaatactctgtatgatatataatagtggatacgtgtcatacatttgtccaaacccatagaatgcacgatgccaagagtgaatcctaattgacactacggacttggatggtgatgatgggttgatgtaggttcatcagctgtaaaaaatgtaccactctgtgtggggatgttgataatggagagggcctttgcatgtgtggggacagggagtatatgagaaatttctattctttctgctcaattttgctgtgaatctaaaactgctccaaaaaataaaatattttaaaaatgagtgtcagaggtaggatatgaaaacatttgtttgactctatgtagggcttaattataatattatactgcttcccagttgacaaatctaatactttcaccgtccaaaacttccctcacacttacttcctgttgtctgtttctatggtttctcttgagtcctccttccaggatccattccaagccagacaatggtatgtgggtgagaaactgtggtcatggaggagactggacagaccggaaagcttttcttttctaacacatgtttctgaggagccctcaggaagcctgtgaaccaggaaaaccacggtgatggtcaatgctctgacagctcccctgcccctttctccatgctcttctcctgccgtgccttccccaaggctgtgggttgctccccactgtgctgctccccttgggccttctctccctgcccacatatgcatgtgccagccctttcccctcacaaaaatgtcaacatagaatggtaagtagaaaaaaaataagatgcaatatcgtacaaatagttgttatgggttgaattgtgtcctcccaaaattgatatgttggagtcctaacccccgttacctcggaaggtgaccttatttggaaataaggttgttgtaggtataatcaatcaagttaagatgaggtcataatgaagtaggagggaacttaattcaaaatgactattatccttattaaaagaatgccatgtggagagacagacatgcaccaaggatactgccatgtggagaggaaggcagagattggggtgatgcagcagaagctgagaaacaccaaagacttccagaaaaacagcagaagacaggagagaggcctgggacatattctttctcacagtcctcactaagaaccaatttgccaacaccttgatctcagacttctaacctccagaaccgtgagacggcaaattgctgttacttaagccactcagttgtggtaccttgttatggaagtgctagcaagctcatagaaataacagaatcctgatcttgtaaagcaaaataaactcatgtattacgggttatcatcttgcatacgcacatacacatatacatagatgaacacatagaaacaatgaaaggcaatatattttaaaagttatcaatacttctttggggataatggatgctgagtaattttgctttgtacttttctctgcacctttgggtattttctcagttatcttacctctctacaatattatgcattattacctagaccagcggtccccaacctttttggtaccagggacctgttttgtggaagactattttttccacaggtggggcagcagtggggatggtttcaggatgaaactgttccactgcagatcatcaggcattagattctcataaggagcatgcatcctagatcccttccatgcacacttcacaatagggtttgtgctcctatgagaatctaatgcttccacagatctgaccaggaggtggagttcagggggtatatggcctggttcttaacaggccatggactagtacctgtccatgccccgggggttggggatctctgacacagacagatccccagacctcagtttcctcatctgtaatttgagaatagttataccaatcttccagcattgttgtgaggaataaagtgcctgacacaaataataggtcagtgggtcttcctagaatagggagagcagctccaaagaagtaaacctggacagacctctgtacctctattcatcatcaggcttcagtgttgctgctaagcaggcatgcggatgctgctcagcactggcctccctgtgtggtaagggtgggtgtgcagagatgagatggcacaggggagctagctggatgtcttgggtttgggaaggtcagcaaagaaaggtaagagagggtgaaagtttgattgaagaatgttggctatgtaaggacaacttaacccattggggtaacatttcttagtttgggttggggtccaatggggcaactgaaaaggaaaaaggaaccaagagaatagaaagcatagccaagaagcccaacaatcccctcctacaggaagaatgccttgcctcctcatttcttctctgaaacccctctggaaatgggagtggacaatgtaacttacttatcattttccacagcccatgggaaggtgttctttccccaggaggaatgtttcccaaacagccctccttctggccttatctgtgataagttgttcttttctggggactgtttgggtatccttgactctgacatactcagtagggcaggttaattctcttgaatcttaaatttagccatctgtgacttcatattaatctttggtctccaaaaacattgggctgttttgcctctttctactcacttatgtcttctttatcttaattccaaatcccagcaactcagagaagaattgggtcctgcaaatgatattcacaatctattgctttatgggaggtcagtgaaggcctttcccatttactttgttaaaatctatatctattttcattcctaattttttatctgcaagattatgtagcaacatgggaaacatttataatattaaatagtgaaagaaggggacacaaaaattgcatgtaaattatgattctatttgaaaaaaagactgagcaaatagacaatcaaaaagacatacacacatacgagaaaaataaaactggaagaaaacaaagcaaaaaatgaataatgactatggtaaagtgctggaattgtggattttttaaattcttctctatttacctaaaaattttaaggtaataagaaaatacttttataattaagaaacagacttactaaaataaagtaggggcagaaatgaggaacaaagtttgctaaaataaataaaacaggaaagcttgtagataaggttttatggaagtaaatatacgtagctcccagcttagtgtgtgtgagctgatggagaaacacgactacagagctcttatggaaagcatttaaccatttgtcacccttgcagtctacttcaagagtgactaaaaggaagaacaacatgaggaagacttcaaatgtgttgaggatttgagaagaggggctagaagtccaggcatgttagaggttttggggctgtagagagatactgtagaagttactaaattgggggttttatgggaagtgcttcaagcatgacattgtgaggctatgatactgtttatttttagaagtcctgttgagaggagtatctttcacctctcactaaattagctatgctccttggaaccatggacatctttctgctgtagcagcaataggatcaaagcacgtgtttagaaagagaagtgaaaaacaccagatgtgagcaaaaccacaaggggaatttcagacaggcagcatgcaccagatgacccaatttggaacgtggcccaggccccaggacaggcagaccctgtaaggatcaggctggacagtcagaggttattgatcccgatttaagccaaatgttgctaaaacttgatctgtgaccttgcttaagccattgacctcctctaaaccactttcaccatctgtaaaatgcaaggactgtgaatttcctctcaggaatagctaatggaaaccatgctaaaaagtagagataagaatgaagcacgatcttgcgatcttgaacaatggtggtaaattgtatttgattatataaataccacaacatacacacacttacagtgtatagatgcgcacactttatgagaagaatgtgtataaaaaacatagaattggccgggcgcgatggctcatgcctgtaatcccagcactttgggaggccgaggcaggtggatatcttgaggttaggagttccagatgagcctggccaacatggtgaaaccccgtctctcctgaaaacacaaaaattactggggcatccacctgtaattccagctacttgggaaactgaggcacaagaatcacttgaacccaggaggcggaggttgcagtgagctgagattgcaccactgcactccagcctgggcaacagagcaaaactccatctcgaaaaaacaaaacaaaaaaaccccatggattaaagattgtgttccatcaattcacagagtaaataatctatgtgttgacaattgaaggggtagaaaaaatattttttctcttacacatagctctttaagattcctagggccagattcagcatactgtctagcacagttagtgacaaatgaatgttagtatagaatagagattatgcttcaaatttcaactgtcttcaccacttagttgctatgtggctttgggtaaggcactctatcattttgtgccttggtttcctaatctgttaaatgggaaaaatactagtatctacctcatagacttgtgaagattacataaagtgatatatctaaagagcttagatgagtgctgggtggataatgttagttattactatcttctaaagtcttctatgtggacttcaaagctctctgcatttctttatttcatctctgttttctcatttaaatgtttcccacattcttgctccattcaagaatatttcttgtttgtcttattcatctatgtaggatattgctccctgtagactttaaaccagcttactcattccccctcaaagccattactgttttcctatttacgtcaattttgagtcagtctctaagttgaccctacaaccagaaatctatgaagcgtcactcaatcctctgttctcccactcctgggcttcttatataacaggatgtcctcttaaccacaggggatgtttcactaaaattaaaatgtatatctttattttctttaatagaagaagtaatcagttatggcatcacagtatataacagaaaatcagcttgggatcactgagcatggctgtctttaagaggatggggcagtgaaaggagtcctgggtgcagtgaaaatgccttctaccctttggagagatgttgacattggagagaaagagggatgcagtactgggtccaggaagggaagatgttggaattcatcctaggtctcatgtaccaaggaagtgactctgtatgagaacagaggggaaaatcaacaactgatcagtgataactatggtattttggccttagggctattaggggatgatgagggcaaaactgagaggaatgttagggaatcactttctctaaagtatcaatataaattgactctacttttggcactcacggaaacagcagaaagaggacatcacaacccctacctggacaacttctgatccagtttcaccaacaacagcgtcactcctttcgaagagcactcttgtcttccactgttaccttgtatgattatgtgattgttatcgtccttatcattatcactctcaaatcacttgaatttcttgcatccctccactatgttatcttctaaaataattttactacaagatgatttaatcccatggaaatttttgagcccctattatgaaggctaaatcctagggaatacaaagatgagtaaaagagtcattgctcttaaggagctcatatcacaagatttaggcagattgaaattgctaaccaacatttaacccaggtccaggtgctcctaattatcttccctattggtttgtcttgtcctgttcatttatttaacacatatttatttatttctttatttgagacggagtctcgctctgtcgcccaggctggagtgcagtggcgcgatctcggctcactgcaagcttcgcctcccctgggttcacgccattctcctgcctcagcctccccagtagctgggactacaggcacccgccaccatgcccagctaattttttgtatttttagtagagatggggtttcaccgcgttagccaagatggtctcaatctcctgacctcgtgtgaaagtgctgggactataggcgtgagccactgcgcccggccttaacacatatttattgagcacctactatgtgctaggcactgggctagcctaaggatgcaatagcaactaaaataagcatcatatttacttttagagaatataactgcaatgtgaagaattaggctcaatgatatacctggttgactacagaagaaatattaagtattcctgtctctcctccacagagtgggatgcactccagtgcactcctcttccaaccattacgtagtgaagttttagctgagacatatttagttcttatgtgagtccaacttgagaggcacctgacaataagaggacaaatctccactgtaatgctgaatagctggtagtctcatgtccagtattcctgtgcaaacacccttgcaggaaccaagtacccttcatattatgccctgattctatatgggttagacatacacatcaaataattttggtttgtcaataaacaatctaaataatagaaggtacagtcaattatataaagtttccaaagaaggataggggaagagtttccaagaaaagttttttcttattggaagaagcatatcagatgaaggcaagcattactttatgtatatatgtatgtatgtatgtattttaaggcagggtctggcactgtcactcaggccagagtgcagtggcatggatcttggctcactgcaacctcagtctgctgggctcaagtgatgctcccacctcagcctcccaagtagctgggactacaagcatgcaccaccacatccagctaatttctgtatttttttgtagagatgggggtcttaccatgttgcccaggatggtctcgaactcttggctcaactgatcctcctgcctcggcctcacatagttctgggattacagatgtgagccaccacacctggtggctcactaattttcactaatggcaataaaaccactacttacaatatcagagtgtacaactaatgtattagctgactaaataagggatgtagtaaatttagtcagggcttctgcctatatagagtaagaccccaaggcatggaagaatgactcactgtaataaactaagccaactaaatattgatgaatagtgctcacataacagcataatattagaacagaaaagaaaattatagattgtactggataactcattcaagcataaaatttggaatctgatggtcctaggttcaaattccaactcagcttcctctttgccacctctgtggccttgggcaacttgagtatttttaaatttgaatactacagatctatattcctagctagtagagttctttctcttatggattaaataaagtaatacaattgaagtcacatggtgcacagtgggcacttcataaatactctagtcttcttttcattgtacagaaaaggaacaaaagcctggaggactgatctaactttcctgaaggcccacagttaaccaatgtcagatccagatgaaagcccctggcttcctgactcctggtccagctggctgtctatgatttccaaaacagggctgtgccaaagacaactgaaaatacatttacctctgtttttttaaagctgaagagaatgaagtaaaaagagaggaggaggctgatgtggggtgagaggtataagaagcagatttactttcctggttttgcattaccttcctgagtttacactgcctgagcacacacccactaacggtggggggaagtggcagagcgtagccaacatgggattaaaaattgtgttacatcaacccacaaagtaaataatctacctgcccacagttgaagagggtgtaacagggtattgtgttttttctcacacatagttctttgggtctgctagggtcattccagatctaattttccagaagatcctatatacgcctttccattggagttttgagcttgctaatgtgtggatttggcagacaaatgcaaattaaagaagatatatatgaaaaatcacttgtagcctaaacatgatttctgtgtgggactggtgctccacatggataaaaaagccatgggccagagacaggatgcttgactgcttccctgcactgctgttaacactcggggggacccaagaaaggagattaacttctctgggcatctattttgtcacctataaaataccatcaagtagtcatttgctatacattgaatgcaagacgtttgtcacattttatttttctgtatccttttaagagcttcatggggcagattgtactcccacattacaagtaaagaaataagggcttagagatattgtgacttgtccaacgtcatttagctggtaagtggtagaatctgacagaacctggatttgaacccagaatctgctttcaacctccaagctacactacttaatattgtgagggagggaaaggatgttaaccttcaaagtactttacatcagtttaaacaaatgttcaatacaatcatttattaggggtataattcctaggaggtgcctgtacttaagtcattttcagctcattgactttctcattcattgcctctcatctgacctgtgagcctcaaaccacagttatcctatttcatttcctttgtttttggtgtcagtactcctcccacattggctgatttcagggggagccggcaccacttctcttcaagtaggggagtgtaagtgtaggaagccactcatacacacacacataaatatgcgcgtgcacgcacacacacacacacacattcatattagtttgtgatacacatacgtggtttcagaaattgacaatttaagaatatgtcattattatgacagtgcatatatcatgtataaataattccccagaattggggttgggtgaaaaaaacgctgtgataaggtgatagaaagtgaagagacatgtactaaggagaatactaagagacttagaaccttctggcttcagcccccaccttgaattttaaaagaagttcatgaattttttcctgctcattcggtctcctgaaagatccttacccttggtaggaaatgagcttgatacaacccagtgttgtatcaactgatactgagctttcactctgttatctgtatctgcattccaggtagtggtggtcatcagactgtaaactttggaggctcagggtcacatctgtggaattctctcttctgtggtccggcatggcatacaattagcaaattggtgatgacaacgtttttcattccttctattgctttttatttggtttgttcaggagacagacacaaaatattttgagactcatttaattatagcccacaactgtcatggcattcaacaagtgcagttattcgttaaatatgtacttgttgaacatcatggtactattattgaacatcacaataatatttcattttttgcattaacccttaatggttacaaagtgcatctataattagtgtcacacctaggcttcctaagaatcctttgagaagggagaaaggaataaaagcattacctaccttatgaggatttgtgagaatcatacaataaaagacaaaagtgcttagcactggaagctgatgcagcgtaaacaatcatgaaatgttactactagcacagttattagcccatattactgatgatatacctcacttcctcaagtttgcacagtgaagtagtagaattcagctaagaatctgtttccagaccccaaatctgtcttaggaaactatcagttgagatcgcaattatggaaggcaaaaaaacagagccttaaagggagagcaaacatgacaggttttatggtgggtgagtaggcagaagtgtttagggaccttatgtgcattgtcaagtgctcaggggagagggtgaggcccaggctatgtaccacaggcagctgtacaattcatttttggttcctcaaatgttctatcttccctcagcaccttcacatagaatgtgttccttctcccctgtcttattctctgtcttcacctctcttcccaacacttcacccaacattcacgcttccaggctcaacccaaacatctcttcttccaggatgctctccctgagcccctgtctgcacctactgacaggcactcacagtactctgcatgcctcctttagagaacagttgtccaatatttgtcttcccagctaggaggtaagcactgagaagtctgcaactttcccttgcttgccggctgatgtctccccagcagcagtgtccagcacgtttgtcaagtgcggagcagctgctggccaccttaaagatggaaaggaacgagactgaaaaaagggtgggaagtcatgaaaacaaatttaaaatgctttactattttgccctagaaccactcggggtggtgctattgggaagagctaggcagtgagaaaacataaaggaggcaacggaaaggagcgagaaaaaagacacaagaaaggcatggagaagtcacttgatgcaaagagtagcagacataggtgctcatcctgaagaaggctgggccatggatgccaagccttccgcagacatatgaaaggttgctgagaattagccgtttctctttctttcaaacttccccttgtttatgtctgccgtcttttgtcagaaagagatgcaggggccctgctctctccagaagactaacccctgcagcagtccatggaatccagggctaagtctgctgaggggagagggagggagggaagagtttccaccaggatgacatatttctgactctgccctctgacaacaaagggtgccggtggtgggacttttggcaggaagcacccacctttgggggagtcagaatcatgttgcggggtgacagtgactgaggcggaccctggagccctggccgtcttccctgcgcggccctaggcagcggtgcctggatgatctcctgggcgcctcctccgaggttcaggcagggctgagggaggatgcgatgcccgagctccggcagggcccattttgtttatgttcccactccttcgccctgggaagccccgagttcccacactcactgaggcaggaaggtcaccacggacacctcatctgtctgggccgttgactaactacagataagcagcagctgccacatccatgttggggtcacctcccagtctgcccaccctggaaccaggggagaagcccccatccccgcccacttgcacatgatgcctccccagcaaggtcagctgctcctgaggccaggatggcgacatggggccacagaaaaacttgcttttgcgggagaagcaagacatgactaagggattgaaaggtcttagacatgactacccgagagcccaggcttatatttccaccttacctttttttttttttagatggagtttctctctgtcgcccaggctggagtgcagtggtgcgaactctgctcactgcaacctccgcctcccgggttcaagcaattctcctgactcagcctcccgagtagggattacaggcacgcacccccacgcccggctaatttttgtatttttagtggaaattgggttttaccatgttggcctggctgatctggaactcctgacctcaagtgattcgcccgcctcggcttcccaaagtgctgggattaaaggtgtgaaccagggcacccagcctaccttacatttgctgagcactttagagtttcacagcgctctactgcctgcatcttttcacatgactctgaccaccacccgtgaagatcgcagagcaggtgtttttgtgtccattttgcagatgagtaaacagccccaggatgttcgagacgcttgccaaattcacacagatagttagtggtaaaagtcatgttcacgggggctttgtgctaccccatgcaaacacaccacaccagctgaacaatcccaatttttatccctaaaagaggactctttctcccaggtttaacctgttttccacccaagcctgccgtgtagtgagaaacatagcagttttggagtttgaatctgattcctcttcttgttaaccaaatgatttagcagttgtgtatttgggacttgatttccctgaatatttgcttccacatgtataaaatgcagataatgctgcctaacttgaacggttgttgtaaggtttaagaataacaagaaacatctattctctgttttccataccctaagcttggttctaagcaccttatgttcattgacttattaaattctcacaacatgcctgtgtgatttcatgcatgctatcattatttcattgtacagttgaggaacaatggcagagaggtaaagaaacataccccaggttacacagagagcagatggcagagccaggattgcaacccagactacagagccgagtgcttaatctccaagctatattgactatgcaaattatgtttactgtccacaatcggcactcaatcaacagctattactaagaattggggaagggtttgtttgaattacaagaaaaatgatcagctaactacctgaactaattagatgaatcaatagtcctgtctactcaaaaatattttctatgtagtattctggtttctaatttcttcccactagattcatagctttagagcacgaagtcacccaagggacttttggcaatgtctagagacatttttggttgtcacaaatgtggggtgctactggcatctaatgggttaggccagggatactgctaaacatcctacacagaagagttcctcaaaaaagaattatctggcccgaaatgtcaatatgctgaagtttagaaactactttaaaattgagtatttagagttgagtcatgattacttaagttttgaagtgccctgctggatccaaatttgacacatatactaatttgtttattcaaattggacacatataccagtaaagtaatgccctgtttaatatctagtgatacattaacatggttccttatatgtgatcatttgtcattacttattgttgctgctgctattgttaccaagcaaagcagatgtgtgccctagaaatggtcaggctgatttggggtttgtggtagagttagaaaattgaagctgtttttctgttaaattacgttaccaacctccaaattgctgacatttcttccaatatattgaagtaggtcataaataaactcacagcaatgccatttcctttcagcatacaactctatgaatccctggtatctttcagtgcagtcagctcttgttttgtgtgttatgtacacaccaaacagatttttaaagtttaattttgttggccccttttgaaaactcctgtagctaatgacattttcaaaatgataaaagttttattttgtcaaacagaactttgaccaacagaacacccttggtacccgatgcacgtgtggcgcatctgtgatgcctggcagcatactgaactttcttactttgttggaaaacactgcgtgtcacatcatcaacactgattttcatatcatcatgcattagcttcaaagactgtgtttataatcctcaaaggagttgtatcagtcagttttagccaggttgtgatacagtaatggataatccccatatcctaataacaaaatagatttgtatttgttcatgttacatgtacaccgtaaattggccactgattacttcatgtcttttgcattcttaatctagactgaaggagctggccctatttgggatatggtagcatcatagcaagggaaatgagaaagatgaaaccacatgatgggtcttaatagtttctgctcagcatatatgacatatgtttgccttctattggtcaatgcaagtccatggccaaattccttccataggccccataggcaggggcagcaaatattttaaacaataagataatctgctataagagtctgtttttgccaccaaagtcacaaacttctaaagagccagggactcagccttgaatcattgctttctaaagatgtttttatcaagaaatggggagagaatgtaaaatgaaaaagttgaagaagtaaaattatcagattctaatggttaatttgataaggagcagagttgggtggcaatgccaaggaaaagacagaaatgaaaaataatttctaagattccagcttgggtgactgataaatgatagtgtcaacaagtgaggtagagaagagagaagaaaaagaggtttagaaggagacaaaacaagtttcatttttgatgcaatgaatataaggtgtctttggaacatccgtgtagaaatatgcagtggacagctggatatacgagtgtggctcctgagagagtactaagctggaaacaaagctctgagatgcaagaccatgtaaataataataatcactattagggttgcatttattgactatttgctatgtgtcaggcactatgctaagaattttcatacaatttgcgtatgttgtattatttaattttcatgtaaccatctaagctgggtatatatatatatagtcgatgttatttatactcatttagctgatgagtttaaaagagggaagcttagggccgggcgcggtggcccacatctgtaatcccagcactctgggaggccgagtccggcggatcatgaggtcaggagattgagaccaacctggctaacacggtgaaaccctgtctctactaaaaatacaaaaagtagccgggcgtggtggcgggcacctgtagtcccagctactcgggaggctgagtcaggagaatggcatgaacttgggaggcggatgttgcagtgagccaagattgcgccactgcactccagcctgggtgacagagcgagactccatctcgaaaaaaaaaaaaaaaaaagagggaagcctaaaagttgatataatttagcctaggtctcacagctaggaagttgcaaaaaagatgcaagtgtttaatctgtgtaactgacattttagccaggtacagtctcagttggaaccatgacggcaaatgagaacatccagaaaccaaagatagaaagaaaagagaagagcagtgggccaagggcaggaccctaaggaatatgaacacttaaggagcaggaagaaaaagagcccttggagaagacagagaaggaacagctagagggagacttgaagagcacagtctcagaagccaagtgtgcagagagtgacaacgaaagggagggtctaacaaagtcagggataacagagtagctgaagagcagaccttggaaatgttccttggtgttgagagttaggtctgctccctgacagcatctctaatctcagggaagcatctgtaaccagcctattccccacccacaactcaggaataataataataaaaaaacacaggtggctagtcacacactgactttggaaacatcaacctgttgctggttcactctctgaactttgtttctcaagactgccttgaattttttacctgtctggatagatctttgtttctgggtcttagtgacctggctttcagtctctacctatgtacacttctctgaggttctggactgttctctcagcttaggaaacccagccttacaccacatccttatttttggttactacccactcccacctacagtcagtgaggttgggcactgaccctcaatccacagggctgtatctccagctgattctctgaaactcagcctccatacgggaaatgagttgtggtctcagctggtggttgctgtatctgttctgtagatgtagcaaatgtctgacaacagggctgctgccttcgagatcacaggttgctggtcagatttgccaagtcttgcactgcctgttgccagagcaagctgtctgtcttcaggtgggccttcccagttgccatgttattttttgtcacagctccagtagcttatggagatagaaggcttatatttggggaagaggatacttatgtaaatgggacttctcatgtcttctggatagtggcctggctatagtctggaagcccacactgtgtggacaccactgggactttctcatagccctgattgattggcaagagtccttgaaatctgtagagtaggcaactacagcatcagagtgggtaagtatccagacctgcctcactctcagagatttgaaccgaatgagccagtattatgaagaaaagcaaaaagcatctcctcgaaagtcctgcaagaagagtcccctctgatgtgagggcaccagaaacctgtagcatctctattatttttgtttagttggaggctgcacccacccatcagccttccctgaccatatccctcagtgagggttaccagacttagaagatgaaaatacaggatgcccagttaaatttgaacttcagataacaaatacatatttggtataagtatatgccacacaatatttgggatagatttatattaagacattattcaacatttatttgaaattcaaatttaattggtgttctgaattttatctggcctccctgtggccaccacaacacccataacttgagacttggtaggaattcataggccttgaaatccactggggccctatctctcccaagaaggcagtggagaactttgtgaggaagaaaagcagatgactgggcctctgctaggattactgggatcctaatactgtctggttccctctcctgggccagctcagaaggaccataaaattagatcttctgagtgcctagcaccttgtctgccttccatcgttgcatttggatgacagagagtttgcagagaacacaatgcctcttgacctatggcagcagcatgatcagtatcctgcaggactttcaaggggatgctttttgctcttcttggaaaatgtcctaatatatcctgaaacatccacatgcaacctgactagctatgcttcatacaatactctagccccaacagttctgagttacctgaaacatcagcaccttcaaaacagcacagaaatgtgtgacatttctgaaccaagttcagtgtagccagttatctgtgattctggagtgagagacaccctggtcactgaggttacctagacattttcaagagatgtctaacaccattttgtctttttctgtgcaactgccctagtaatgacctcctaaaatagagaaggaagtttcctgatgtgctgaggttgacactatgtttggcaagtcaagactcgctgcacctctgctccagtacagcacaagcaagcactgacgatgtgccaggcactgctgaaagggcttgcctatattaactaatttaatactcatgataaccctatgagctatatgctattattattgctgttttgcggatgaggaaactgaaacatggagtgataaagtaactcctataaagccatacaggtaaaaaatttactaagaatagaaatgaatgcaagcaactcagctccacagtgtgtcctctgcacctgcatgccagctctacacagctggaacctagcttcattcagcatcacactgttgagactggtgctgccaacactgtggagtgggccaccctgacccaggagaagctttatgccacacttcattatccctgcgtggaaaggggaagggcctgtggtcaagcatgttttcaagccctagagggtccaatgtgtgatagggacttcagtctgccatagcctgaaagctcagctcatgctatgcaaggcagctcaccttatctgtgcttgggtgctccatcagctgtgtgcccagcactcagaatcacagaccagattctctatcctgaaagcctgagtacaagaggtaacagagagactcgctctggaagactatggcttgagtatttcacaatcattctgctcaaatgatgtattttagacattgatgcatggtcttaatcctgatacagggcctcttggggcaatttggattgatgttaaatgccacgaagctcttcataggagcaaggcagtgctcatccctgctaggaaggccagaatgcagcctcagcacagccactggccctccctgaggtgatatggtctggtacactaccacaaaagcacctggacccaaagcaaagatacctcagggttcctctagagccgcggtgactccttctgatccacactcgcatctgaaactccagttttgggacttctatttgttgtctgcccacttcctggattgattgattgattgattgttatagagacagggtcttgctatgttgcccaggctgaactcaaactcatgggctcaggttatcctcccacctcagcctcccaagtcattgggaggtctgcccctcttgacctcttccctgactctgccctcttccctccctgcattgctcctccacccattccagtcatttataccctgataggtaaaagagggcttctactttcatggtctctcaaagcactgctttccaaccacagccctcagctgtgcctcagtttgggcctatcaggtctacatccacatacccaccacccctagacaggtgacaaaagtagtgcttaagaaacaaatgtgcttttttgcctcccccacacaactgactgctctggctaatatcactgctacacactttgctttcactaattattattgcctgccctccagaactgcttttttgcatacaaaggtttttgtccttagtgttttttttacacctcttcttggtattattattattgttttttatttttttatttttcgagacggagtctcgcactttggcccaggctggagtgcagtggcgcgatctcttgactcactgcaagctccgcctcccgggttcacgccattctcctgcctcagcctcccgagtagctgggactacaggcgcccgccaccatggctggctaattttttgtatttttagtagagacggggtttcactgtgttcgccaggatggtctcgatctcctgacctcatgatccgcccgcctcggcctcccaaagtgctgggattacaggcgtgagccaccgtgcctggccctcttcttggtattattgatattcctgcagctagacagtacccgggaaggaatgcaccaactagaaggagctttaatgagcctactgtgttatggctggcatcagccttcagagaggtttgagcataggatgccatctaattccccgccagcccattcattctatccaactaatgggaaaactagaggattgctgataataatagcatcagcaaaaatagttaccatttatcaagcatttactatgggccaagtactacgctaaatgctctgcatatattttctcacttaattctcaaaaaatgcaatgaggagaatgctattttatctctagctcacagctgagaaaactgacctgccaaaaaagccgcataatgaataagtgatagagcaaaattttgaacgcaagttaatttaaagcctgggcattcagccactctgctgccattatcatacatcatctgacttccttcatgtcccatctcccaacttctgttttttattttctcttttcctgattctccagttacccaccctagcagtggaggtgatatatatgaactgcatgccaaagtgggtgtagactcataatgacaacataatgacaccaactggaccatgggaaatggtgaaggcaagagtagttatttcaacttggccctttgaaacagagaccctgccgcaagttatgaggggtttaagtattttcctgtttcatttgcccttagatcccaaacacctagaactgtgcctagctcatagtaggagcccaagaaataccagcatggaaacctggaaagctggggtaaatctgatgaagagcacaggagccttagtaaatccgggtgatctgaaactggctcttagttgagccagatgataggatcttaatgacaattgtgcaccacttctcatttcttgcgactctttgcaggtttgcttcttgctgtcttattccaactaaaaaattctgtttacttttcatgtattttctctacctcagaattgttgcttattcataaattctgccttcttatcacatggttctgcttcctcatagttttggtttgctataatcctccatggctccactccattgtatgccatcctttcagcttcagctcccatggctaactgcttctttctatccatgtttcccaattcaaatcccagaaggagagaatctgattgatcaaacttaccttttccactcaagccctggtttttgggaaggcagcccctaatgtcaagggccaatcactggtccaatcaggagccatccctgggcaaagaacaacctacctctgcttctcaaagcagggggctctgggtggggcactttcatctcaaagaggaagttgggtgtggcaggcactgtgttgacatatccagtataggagtgccctgggagcccatctctcatttctgaaagagatagcattgtagatctggacgtttcatcacatattcccaggaaagcccagccaaatgcagctggtaagttgctgaatgtggaattcctcttggccttccaactccttgcactcttccttctgggactactttggtttttcagtttattacctgtttggagttggcttgtttctggactctctcttctgctcaggtgagcagacttctaactggaacgcctggctcttggacaaggtgagtgtttggatccaactttggttctgcaccattctttcaacttggatgacattgcctcacctcttgtatccttgtcctctcccttctactcaatccactctgctctgggttattatttacctgagggtgccttcccttcccagacccaccaacatactcctgagggaagaacattcaaaagcagctggtggcttcagtgagatcaatttttagaggaatgatcggggcagaagctagatagaagcaagttgaggaagtggaaatagtgagtgcaagacacttttctgagaagtttagatgaaaaggaggggaagaaaacagctatgtgtcaagagtttggtgtgtgtgtgtgtgttttattttttttgaaagaatttgcttcttattatataacacatgattttgtaaaacattttgaaaaaaacaaaaattataaacaatatgtttacaattgcccattaaactactacctaagtaattacaatagttaccaatttttgaatacctactaaacagaagaattatgctaggaacttcatgaattatttttctatttcttgtgcaatacaatgtcccagatgggtcagaattcagacagatatggctgtgatgcagaattagacaatgtctcttccctttaagcaatgattggcatccattgatttataagggggctgagaagtttgctgggggcaaaatggaaatatttgcctcagtagggtcttcagcattcatgggcatgtctggagacagttccagaggtaggcagagtgctggcaggaatggtggggcccctggagagagcaccgttggttgaggaaggagtttgtaacggtaagactgggctttagacctggaaggtcgtggtaagtctgactgtcacagggaagggcctaacccagcttccttgcatgtgtcttcccagaagaaaacaaagaagggcctctgagtcatggaaagagccatgaaactctttaatgctctagggcctatcgcccagtaactggtaactcagtgttatattaaggaagagagcttttcttttcccactttgaaagaggatgctgacagacatcacaggggctatcatagccctcaatttcccataaaaccggcaccacagtgccagctgtgattgcagaaaaaggtttttatccaagttgtgttaaggaaatagtagttgatttcagttaattcagtcataacactttaccttgagcattaatgctgaaaaagtcaactctcttacttcctgtttttcaaaagcattattggctagggtaactgtgcagggctccacgctgacaccgtttgtggacttttagctcacagtggtgctgtcagtgccagcatcttggtgtctggctaactataacaatacacatgatgacaacactggcttaagaacacaggtaagatctgtccaccaatgacacccaaatgtctttgtacaaaaacacctactcgatgaggccctccctgaccaccttatgtaaaaccgagcaacccctctgccttcctaccctctgcctaccccgactttctttccatagcacttatcatcatctcatgttttgtcatttttgtttctttttcttcttttttaatcatcgtttttcctgtcccaaaaagcaaatgccaagaaagcagtgtccaggtctgtctgtttattgttgtgtccccagagcccacatcagtgactcacacagagtgctcaatatttattgagttaatccatttcatgaatttctcataaatatttggggaaggataagaactatgaagatttttaattaacatgatcacatttggatttatggctcaggagaaccaaggatatttgcttacatttataccacccttacaaggtccatactctaatatggccactttgcaggtgaggaaactgaggatcagagtgaaagcaacctgcctcagcccccatagataataacgatcagagccaatataaactggtgtagtaagtaagaagacaaagtaggtagtattgctataggtaaagcaagagctaaggaaagccttagttgatatggcagaaataggaacagagagaaagggacagaaaaggaagaaactgtgaagcctgattagaaatatggaaggcagaattcaatatactcctagaagcagcccatgaaaataaaatgaagaaagaaggattgtttttctaagaggagggtggcttcaatttctttcagaaaagattggctaactgaaaactaagaaagaaacagaccaaatccttgtagcttctagcacatctatgataaaattctgttaattggatttcatacttggattataactgcacaacacatgagagtaaaatgccttaagacaaaaagagtaaaaattgagtcataatatggagacgatactattctggcaatagtattcaaagaatggaccagggagcagtgcacagctttgggaagcaggggttgtcaacattaggactcagagttgttagtgatgaggttcccaggcaacataagagacccttgaaaaaggctttggcttagggaaaaagaattataggggccagacgcggaggctcacacctgtaatcccagcactttaggaggccgaggtgggtggatcacctaaggtcaggagtccaggaccagcctgaccaatatggtgaaaccccgtctctactaaaaaatacaaaaattagctaggcatggtggtgtgtgcctgtagtcccagctactccggaggctgaatgacttgaacccgggaggcagaggttgcagtgagctgagattgggcgccactgcactgcagcctggggcaacagagtgagacttcgtctcaaaaaaaaaaaagaattataggacccaagtaagaaggtctggctcccttggcatttctcaccccctggcccattagctggtgttgcagactccactgtggtactccaaggggttttagagaaagaaccagggcagatgaccatccaaatcagaagggccaggtaggatggtcagccacacatgtgaggggcagatagggaaacagaagattaatgcatatgggaagccccaggaagctaaatccatcccagatcacactggatactggctctgttgaggcaggtggtggggggtcagcctggtgacagcatatttgttcattcaatcaatatttactgaatgctctttatattctaggcactgtgccagacattgggctaggtgctgggaattgaaataataaactatttcctgatttctcttctctcttctggagaaagaattggattagaacaaggtatggttctcactggcacagggattgggcaaggccgtctgcaagaggcagacatcagcttgggcaatggggtcaagttggggatggcaggccctggctgatacaatacttatattttacctgaaatctgtgtttattttctatcttgaacctggtattgtttatatttgataagcaaattttatgttttaagtaattcctagacatacagttaggacattttgcaggggagggcttttgatttttaatcctaaaagcattagtttgtctgtattgccgggcttgacaatcacataaaataagtgtatttcaaatcactcaataggagtggctgcaaataggggaaagaacatgatctattactactttggattactactttttactggcaaaccataaatcacagtggggaagccacagtggagtataaggaacttaaatcatggcaagagtgatttaaggtcagtcagtgcagcagataatctggagagatgatcccactcataaccctttaagacatgacacttggtaaactacctaactcataagggtgtcctggcagtgaacctccacacctcctggttggggtgtgtgctccatctcacccagcttaagtaggcctgaaagaccaccctgttctctcaggcaagagtattcctcttcattactggaagggaattaaagacaaagctggtctaatcaataaccgcaggcccttgtctcactgagaagaataaaaatgaatacgcaattatttgccattgtggaatgtgttttccctagtatcaatgctgtatgtaatactaagatttctacagcctatttaatatagaatatatacatacacgcacatgcaaacacatacacacagatatatatatatatatagttgcctcttgtatggtatccagtcaagtgtctttactgtaactggaaatcaaaattacatcaatagaaaaaaatgctacaccagtagaaaaggtgggggggggaataggagaatgaaaaaggggaggagcaaaaatgaaaattcacttttaaacaaatgtaactttggctatatggttacaggtataggttctggctgaaaagatttcaatgtctgctttaatgtaaattataagtattccagaagacagataattttattttactttttttttttttgagagggggtcttgctctggcccccaggttggagtgcaatggtgcgatctcggctcactgcaatctctgcctcccaggttcaagcaattctcctgtctcagcctcccgggtagctgggactacaggcacccgccaccacgcccgcctaacttttgtatttttactagagatgggatttcatcatactggtcaggctggtctcaaactcctgacctaaggtgattcacctgcctcagcctcccaaagtgctgggattataggtgtgacccactgcacctgggtgacaagataattttaggagccactttaaaaagtttccggaactgtagtctattatttcagtctcagtcccatacaccatgaaaaatttagggcatttcattgctacaaagaattttaaagcagaatcaatccatgtaattaaatcttaacatttattaagtgcttattgtatatcaggtacttttacttttctaatcattgtacagttattaattcattcaaatcttacaaaagtctatgagttattgtttccattttacagatgaggaaattgaggcacaaatattgcccaagatctcacagttagtgattgacagtaagattcacactcagaccatctgactctggaggccacacttgtcattcatgttaatcttacttaacatgcttcatgctaactacagacttagttatctccatatgcatctttcaagtagatggcttatcacaacagcaattagacctgtttacatgtttggcgcttatttattgaatgattacctactacacactgaaattggttaagtttgtttctaaaactgacaagctttgttttaaaaacaattcatcttcttccgctctttttttcacaagaggtagttgtttggatagtaaccttttgagaaccaaaagaagtgaaggagagctacttttgtgagaatgaaaggtggagggtcattcattcaagaacttgtttttaccaggtaccagttgtcagtatgcaaaagcagcgaggtatgccaatgtaattcatgttcaataaacatcataaaatttatttctatacattaaaatcttcctgtgtaacaaaatgcatgttttatttttatctgccacttttcttaagtcagtagacaattccctcttctttctcccaggcttgatatgaggttagcttttcacaattggtacttctgggggggcaaaaaacaggcaaaataagtgaatgggaaagcactcagacttattatttattaatttgtgatattctagcctttcagtgactcttttcatgctattttttccaacttctgtgggatggggaaaaaacttatccggagtgacaacatttctattttccattattatttcttgcataaaatattcaaaaacaattgttttggcatcatctcacttcgaagataaagaaagcaatagtaaatatcagcctgcatattgggaattcttctagagaatattatttagacttcatgaaacaaaagaggagctaaaattatgctttgtgtaaatctcagatagtggttttggcttaaaatttgctatcccagcactttgggaggctgaggtgggcagatcacgaggtcaggagatcgagcccatcctggctaacacggtgaaatcccgtctctactaaaagtacaaaaaaatgagctgggcgtggtggcgggcgccggtagtcccagctacttgggaggctgaggcaggagaatcgcttgaacccaggaggcggaggttgcagtgagccgagatcgggccattgcactccagcctggtgacagagtgagactccgtctcaaaaaaaaaaaaaaaaaaaaagaactttctgttgtgttaaagttaactagcgaggagactcttgattcctaagaaatattaaccttatatccccaaatatatttcatgtgcagttcaacaaatgaaagttaggtgctctgaataggttttggggttaatgagtctattagaatacaggctttttgtatagcagcctcggagagctagcccagccaggcccagtttctgctgtttctcaagcacaggaggctgagagtagagaaaagtgctctgtaagaaggctgagcccctcactggaggtggaactactaccctacatgttttgtttgtttagatgatacgctgagaaccaaatctaccctgtcagcttactcttcaagaacaagccaagcaactgaaactgagtccacgctcagctaagtcaaagcccaggggattactggcatcaccacccaccccacctggagcatgacaatgtctgtgagagaataagagatgggtggtgtcaccactatctttctctttctgttctccaaattataataataacagtctcttttcctcctctaaacattttttataaaggaggttgaactcagttgaaatatcttgaaattactgtggctggtttacaagccactctggaaagttatgctctggcataaatttagcagctatgttttactgtaaaaagaaacccagggacatagcttattaagaaaatgtggtcaaagtgagaattttctttggttttatgaataaatatagatattatattacaaaattagatttatatcgttgagcttgatactagacagtaaatattatttcttaggaaaaggttaatacatcattaaattttaaaagttgaacacaaaatctctaacaaattaaatttaaatatttccatttcaatatcattgcagacagttcatggtagtgaagtacattgagaaaacttgttctttaagaaaacaaacttctgggtaaaagatagtaatatatcagcaaaaaaagatttttatcaagagggttgaaggctatagcatcatcaaggtaaagatcaaatagcatggaggctaaaataaacctgtgcttttttgagcgggtggtcaatagaaattggctctgttgctggagatcctgaattttaaattctggtgatcaggccagtaatatgctgatgaagcagaaatgtcacagcatattttaccaagtcaaagacaggcaacagttatgagagggacatggagaacctggtagagctctgtgtactatgctgaattaataaatagagaactaacttaaggtggacaaaactgctgggtgtctctcaggcttctaatgttttcaaaatgtatttgaagacttaaagccttataataataagaagaagagtagtccaagttctgtttatttccttttaaaaggagtcaacacttgaggagacaattctgtactcccacaacaggaaaaatgcatccttttaccgtgtgaataattgaaccagagtcattgcccactcttcaggaaatagctcatgtaaacttttggccgacctgtgcttcacagtgcacttacctcttgacatccacctctgtaaacttttatttgtattaccaaatattgactgcaaacaaaaaaaaaaaaaaggaagaaaaaggaacctcccttatacaattacagaacgttagagcaaaagagaactgaaagatgatcttgtgcaggccaccattttatagatgaagaaacaaaagcacagagtgacttgctaatgcttcaccaagctggcacagcctggcctagagctacattcccctgtgtcccagacccacatgccagcaccaacatcatggatcctctctctctctctctcttgtgagacagagtctcactctgttgcccaggctggagtgtagtggtgcaatcttggcttactgcagtctctgcctcccgggttcaagagattctcccgcctcagcttcttcagtagctgggactacaggcatactgccaccatagccggctaatttttttgtatttttagtagagacgggatttcaccatgttggccaggctgaagatcctctctcttattgcttgatgaaaaaatgtattaggcactgggaggatagaaattaaagagccccaatacttgacatctaggagctcacaacccaataagaaaagtacacatgtagaccaccctccaatattttactgtactctgtacactgttgctagaatgatctttctgaaaatacaaattgtaatgtatctaaccctgtgtaaaaccgtgcagtggctccttgttgcctgtaaggtaaagctttccccttgttctccagccttctgtctaactgggtctatgctgatgctcaggatccagccatagagaaccaattgcttttccctaaatatagcaggcttttccctaaatatagcaggccctttcatcctgccaggcctttgttatgctgttctctgcctggaatgacctcctctcattaccctccaggagggttatctctcttgtaatagatttccttaggtttctctccttccacctccaaccccacagacagaattaaccattccttcctttgtttatttgtcctgcccatatttctcctacagcacctatagtgctttgtaacattgatttttttttttttttgagacagagtcttgctctgttgcccaggctggagtgcagtggcgtgatcttggctcactgcaagctccgcctcctgggttcacgccattctcctgcctcagcctcccgagtagctgggactacaggcgcccgccaccatgcccggctaattttttgtatttttttttttttttttttttgagacggagtctcgctgtcgcccaggctggagtgcagtggcgcaatctcggctcactgcaggctccaccccctggggttcacgccattctcctgcctcagcctccggagtagctgggactacaggcgcccgccacctcgcccggctaattttttgtatttttagtagagacagggtttcaccgtgttagccaggatggtctcgatctcctgacctcgtgatccgcccgcctcggcctcccaaagtgctgggattacaggcgtgagccaccgcgcccggccaattttttgtaattttagtggagacggggtttcaccgtgttagccaggatggtctcgatctcctgacctcgtgatccgcctgcctcagcctcccaaagtgctgggattacaggcatgagccaccgcgcccggccgattgttttaaaatacataaatgtacttgccatttacacttatgtctttctctactaattgaagataagctccttaagagccatctttgtaagggccatctttatctttgtacccctagaatctagctcagtgcctggctcagaacaactccattgaatgaaccatccatacaggcccttacatcatgctatgggaatgcaacagaaggagcagtgaactgtgcttagaggagttgccttggaagctgaagcatgtataccaaatagaggaacatcagggcagggcaagggttggttcatagctggtcgccagaatagaatgctcaaaggtacaggggcctgagaagtggtggaaaggttggcaggtttgggaaatttgaggatacctgagaggatggactgtgggatgtggtggtttgctgttattattcttattgttaaaccagaagaagaggctatgagttagtcaggggctgtgtgttaaaaggcctggcaattcatgctgagaaaggagttttgattatattacaaagagctaaagaaagaagagttttgaaggtcagtattcaagagtagggatgattggatatgcctgtcagagacaaaggacaatgcagtgaccaggagaggttgctccagggaggagtgggactgcatcttagagtctgggtggggcattggtgatctgagggttcagagaactgagaatggtccaggtgaaaactgatgagggcctgaggcaaggcagtggagatggagaaaatgagaatgattggagaaataaacacagcagtggtggaatggtgactggcaatcagctgaagatggggaataaagggaaatgaggagtcaaaaatgatcccaagtgtttatcttgaatgtttaagcagatggcgttgtcctgatatggaatgcagaaaaataacatcgagttgagtttgtgatgctttcgagatacttaaatgaaaatgttgagaaagcagttgaaattacatgtctcatattcaggaaagagttgagggcatgagtctctctaggtaataactgattccataggacaggatgagagcatctgagagcatgtgagggcgagagaaggtctagaatgaggccctcggttaaggaggagagagaggagaatgagacaacaaagaaatccaatgtggagtcatgagagccatagaaaaagagtttattcacagggaagaaagagtttgtagtgttaaaaatcaaagaaaggatatagattgaaaaaaaggtcctgaaagaactgtaatataaggctacaaacatactcattgggggctggaggaagtccaacataagccagccccagcgttgagccagtgaatcggagacaaaaggctccctctcttttttagtcccagccagttcataagcctgaggttgaattgcaactatgatttatgctaaatagctttatctaattagggctggtaaaattgaagtggttggaatacctctggcaagaacttgataaaaatttgagagtctttcacgttaattttaatcttcgtttgcatgaaatgggatggttaaggagaagtaaaagaaaaacatgaaaaggaaggcacaataagaagcattcattctttaaaggaaaatggtgtaccaaagagtcgtcccagagctcttccttctcctgcctccacatagtctaaggtctgtttacaggaaaaacctaagctagcgtggccaatataggttttaatgggtgagccaaaaaaaaaaaaaaatgctttcatggcaaaaataccaaaagcaatttcaataaaagcaaaaattgacaaatgggatctaattaaactaatgagcttctgcacagcaaatgaaactatcatcagagtgaacagacaatttacagaatggaagaatatttttgcaatctattcatctgacaaaggtctaatatccagagtttacaaggaacttaaacaaatttacaagaaaaaaaaaaccccattaaaagatgggcaaaggacatgaacagacacttctcaaaagaagtcatacatgtggccaaaaacatatgataaaaagctcaaaatcactgatcattagagaaatgcaaatcaaaaccacaatgagataccatctcatgccagtcagaatggctattactaaaaagtcaaaaaacaacagatgctggcgaggttgtggagaaaaaggaatgcttttatgctgttggttggagtgtaaattagttcaaccattgtggaagacagtgtggcaattcctcaaagagctagaggctgaaataacatttgacctagtaatccaactattgagtatatacccaaaggaatataaatcattatattataaagatacatgcatgtttatgttcattgcagcacattcacgatagcaaagacatggaatcaacctaaatttccatcaatgacagactggataaagaaaatgtacatacataccatggaatactacgcagccgtaaaaaggaataagatcatatcttttgcagggacatggatggagctggaggccattatcctcagcaaactaacgcagggacagagaaccaaacactgcatgttctcacttataagtgggagatgaatgatgagaacacatggacacatagggggaacaacacatgatggggtcagtcagagcggggtgtgaggggagggagagtgtcgggaagaatagctaatggatactgggcttaataagcaggtgatgggatgaattgtacagcaaatcaccatggcacacatttacctatgtaagaaacccccacatcctgcacatatacccctgaacttaaaagttgaaggaaaaaaaaaaagtaaaaaaatgccatcatgatacaattaggcacttataaaaaatgtgttccaaatccctcaaaagtgttttagtaaggggcttactaagtatggagatttcaaatgtggtatgtggatggtgctaaaattgagagtaagcatttagaaatttttagagcaaatcgagaatgctgtaacatacaagcacattgtcagtggactcatgtcaatgagcagggtatggactggtctgggtgttgtggaattctcatagtgagtcacaggtggcatgacctgtgccctagtcatacgcaggaagacacttagaccacaagcttggaaattaaaaaaaaattaaccacacagatagtttgaaaatcactgctttagatcacaacctatttgtaagttaagaggccctacagctcgtttggtgcaaggaagttgacagagagcttgagcatacaccaaaaaatttagatataaagtgacgggaaatttgaagccattgtagaagatacgaattggagatggaactacccaaaattaccttctataaggatcttctagattaaatgcaagctaacttattcttaaaattgttttgttcattatgatatgaacagagtctatatcagaacctggaacatggcaggcactaaataaatattttatgaatattgaattagttgttctaacaacatcgtggagaatagcttgagaagggtaaaggctagaatcagaaaaagtggctaggaagactttaaagactgtctagacataggttgatgggtggattagcctagtggatacagagattcagaaaatatgaatctaagaaatattgggaggaacttccagtttttcccatgtcagtaagcacatggacattcatcaaagtccaaatcagaaatgtggggtcatccttgactcttctctttctccttgctcctcatatttggtcactctctgaatcctaaatatcgctaccctgccttctcctgctattcacactgctttagttcaagccccaccacgtccctccaggactttgttatagcttccttaaatggtctccctgccctgggttcttccccattaagcttttcttccaaaattgaaaattcagtgtttttccttttttgtgtgaaaccatgaaatggctcctgatttaccttctaagcttcagcatacctaagctccatggtagggctgctccttaccaggccttgtgtcatctggcacttgctttgcatgccagtgcattcttctgctccttacttggtggttcttaaaccagaccaacactaaacaactggtaacccctgccccaagggtttgccatgttatttcatgcctctgtgcctttgcttatgctattccttctgcctgaaatgctctcactcccagcaccctggctgcttttccatctgtattcatttcctgttgctgctgtaacaaattatcacaaacttactctttttgaggtcagaagtctgaaatgaggctatttcatgaggctaaaattaaagcattggcagaccttcatacctcctggagctggaggagagacactgttctttgcctcttccagcttctaaccacagtttttgtttttgtttgtttgtttttggttttggctgatggtccctcattgtcacatctctttctctgacactcctgcctcctttttctataaggacccctgtgattacatcaggttcgtctgaataatctaatcttcccatcttccttaaacgtagtcatatctgcaaagtcctcattgacatgtacggtaacatttacaagtttgggatgtggatatctctgagaagccattattctgcttactgcaccacccaaccccaattagtctcttaaagctctgctatcactttttctctgaaacatgttctgctcagagctaatcactctctattttgtgtcatatacatactaccttcactgcatgggttggcttgtattgcacataataacttttaaaacacatctacctctctattatattttgatttcttgaggggacagcttatttatctttgtattaccagcggtaagcatgttacatggtatatagcaagtagtaggagctaaattatactatttaaaaatgaatgtcccaggcagtgcaatgatccatttgaatgttaactagacatgtaggtttaaatggtgactacagttgtggtgcattcctaactttgcagggtcgttgcctaccactctccctgcccacgcttgtctgcttcccctccagtcacatggcctttctaaccttccttggtcatgctgttcctatcccatcctcatctctctgtctgtaatgcccttcctccaacttttcttttcataaatccctaattcattctcaaagcacaaatcaaaactttttccttctgcaatgccttttatttgtctcaagacagaattcatcacttcctcttttgagttgctaagacattttgtacagatctgtattacatatttcacattgtgttttgcttggttttatatatgtatctgttccatcacaagaatgcacaaaagccatatcttgtttatatcagtactaggcatatagcaagcactcaataatgtttatgaccttaaagcgaacatataaacagatgagaatggaggggcaacagaaaggaaccaaaagattaaaagagtgcctttgataaaagataaagaggaaggaagagactgagaagaccctcaaagacagcattcagaagaccctagaggcagagtgtgatgaaggctggagttagagtggctgacctctaattaaagaggagaatgtgagaggcagcaccacatgcagtgagctgcaggcctgagaaagagaaaggctgttggatgtgaccacgaagagatcctaatggttttaggaagcataatgagaatgcccagtcaggaccctgggtctgctcctgtttttaggttaggagagattaggttaggttaggatctccagaggataaatgacttgaggaaaaggaatatcacacttcatatccaatcaacttgcttgaatgcttgaggccatgaacacctcagcacagctccaagtcagtttggaaggcttggttctttcatctgataccacgacttcaaagtactaggagatgtagatggttctcagggaatacagaggccaacataatgtattcccctataataatcagagattttcatcaatagggcacagttggctgggtggtccaggctcctgaggaacaaaggcaaaatgtctaaatctggcttcagaactgagaataatttctctttcacggaacttttctggatgatgatatttctctatataaagcattctctgacccagtggacaaatatttctcacatctctgcctgccttgaaccttgccctcctatcttccatcaacactgctgtcagctgtattctccaacctgtgtcttgtttggctaacctgtatggccaactgtctgtctttacctttacaaagcctgatctagacaaacttctatgctggacatctgcactgattttcgcccaaatcaattgtctagcatctatttctgtgatctgcttctgctgtgtcctgaatcagtctgctgtggtctgataggttgcacattctcaatgggagtgagaattgatcttgggggataaaaaacaacttaattttttaaatgtacaaagtgcagatatacatacaatgcataaaccgatatcacaatatatctgcgtgtattagggctctccagagaaacagaactgatagcatatattatatatagatacacagaaatagatttattacgagagattggctcatgcaattatggaacctgtgaagtcccatgatcagctgtctgcaaattggaagcccaggaaagttactggtgtattataactccagtccaagccagaaggcctgagaaccaggagagccaatcctgtaagtcccagtccaagtccaaaggccccaaaaccagaaacactactgatatccaagggcaggaggagatggatgtcccagctccagaagagagagtgaacttgtgcttcctccacctctctgttttattcaggccttcaagggattgcttgatgcccactcacactgccaagggtgatcttttattcactctaccaattcaaatgctaaccttttccaagaacaccctcccagacacacccacaaataatgttttaccagtgatctcagcaatccgtagcccactaaagttgacacacaaaattaaccatcacactatggtaccaaaatttgatagaggagagcaatttttaaaaacatcggaaaagcctccttaggaaggcaataatgaaaagaaaagggttgagaaatattgtgataggtgatgaggctgcaattcctgtaacagaaggaacataaggagactggattgtgaggaaatggaggtagtcacagttatttgactgagaagtagactacagagagaattccgatgaagcaaacaaattatgagcacttattatgtgccatgaactgtgtgaaaccctttcacatttgttagcaaagagcttctcctttagtagtaatgtacatattccttgcagaaaaaacagtgacattttccattgagacagtagcgcacctatctctcctctgcttcagcagcctttatgctaattactgttttggaagtaactcctcattcactttttgcaacataagataatgagaaatacagcccagattttgtttgtagaagctcctttcatggcagcctttcaacagtttgggtaatttaaaagatgcagttgtaatcgtgactaactcattaagatgcttgatgagcatcttaatgagttaaaaaacctggacatttttaacgcacttttggaaagaggcaagaaaaatataagagtgggaataatccaaggaaaacatttcaagtctttgaacaatagaccctagaatttccttagcttgagataggttaggacaagaaaacagaatgttgcttaaaagaagcccagtgatcatttgtgtctacttgcacttctggaatatgacttttgtttgttagttggttcattttgacttaaaaagtgtttttcggccaggtgcagtggctcacacctgtaataccagcactttgggaggccgaggtgggcagatcacaaggtcaggagatcgagaccatcctggctaacatggtgaaaccccgcctctattaaaaatacaaaaaattagccaggtgtgttgacgggcgcctgtagtcccagctactcgggaggctgaggcaggagaatggcatgaacctgggaggcggagcttgcagtgagccgagatcgctccactgcactccaacctgggcgacagggggagactctgtctcaaaaaacaacaacaacaacaacaacaaaacccacaacatttttctttgttctctctcagtactcattaagaatttactactgcgtctttagattttatctcaggcagatcaatgctatgtatttgtcccctgtacttgatccctgtgctttccttctctcctactttcctactcttgtcatgagtgctgaggcagggatgatgttggggtggaaagctgaagggcgaagatgaatgagccacagtgtccacttagaatctacagccaactcttggcagcttatccgtggtaattcttgtttcagcttcttgttgactttatcacccactcaatgtgcttaattctatgatggatgttatcaccagctctgtttattcacaatgccaagaacaccagtggaacagggaaatattcaggaaaacccactttatggtgtcaacttgaccagaaaacgaaacacaactccatcattgctttattgaatttggcatcgttctagaaataaactatcatttatattttgtcaaacaaaaagaagaggagaagagatttcaaaagcactgcttctggggagggtctggatcaaaggtaaatgtgtgactttaggtgacagaaaagcatctccactcagatgcatccaactttgagggggcactgactacaggacagtagagacaagggacactcatgaacaagcagcttttccaattctgggtccttttcaaactgtagtatcaacatatatttttaagtttcataaattcttggaacattaaacatatccattcaaacagttctttcaatatggtggatatttgtaggctgccctggaaatcagaacaccttgaatttaattcctgctatgacactggctgactctgtaactttcaccttttttagttctccaagatgatataaataatggaaaacatataggactctaaaatggttgcaacataggttcaaatctgacccctaccacttgttagcttgtcaacattggataagttatttgacttctttgagcatcagtatctttatttgttaaatggagataaagatatctttcttgcaggaatgttgtatggatctaatgagatcatgtatgcaaaacacccaacacatagttgtcactttataaatggctgttctagtagccatttgcacagagatggggaaaggctaggtgacaaaaggcatgggcattctgagctcatcagttgatagggcttccttaatgccatagctttattagagaaggaggaggatacagcccagccacataggaactcaggcctcttttatttctgcaggatctggtcaccacaacaatcagaatgtgcaggggtaagactaaggaagagagagagaggaagaatggatggtgggggggggggcggctctcttcttcctagcggcagagaatcccgcagtattccttcagttgcagaaactaaatggaaggcaaatggctgtctgcttgtggtgcatgcaccaagacaaactactaaagtgtttcctgcccagtccccacaggtgttgcttctcagctttggataagtcctccagcaagtactttgttgaaagcgagaaaggcagctgcataactctccagtccacagagctgacaaatcactgtgtcatcaaagaagagggaatcatgggaaatagcctgtggttcaccctctaaggcagggagtcaggaggctgtgaggtggcacatttgattcttgctcattaacatagtttctctttgtgtcctcctcctcctctttgcctgcttgcctgttccactgggtaagcagcaagtgcctactcaaatcattatttatcaaatgtgtactatgttcccaacattcattcaatacacctatattgaaagccttttatgagaataacaaaaataacaagatagattcagagtaagattcagagactgaagcaagtccgcatatagtaatcacatgttcaactagttgttaagtggtatatataatacatagaaaccaaccgtggaggacctcagggaaaggagccaggaagctgaggaaggctttggagagaagatgacattggagctaggccttcacccaaaattccataggtgttggtccattttgcattgctataaaggaatacctgagactgggtaatttaaggggaaaaggggtttattttggccaggactggtggctcacatctattatcccagaactttgggaggctgaagcgggtggatcacttgaggtcaggagtttgagaccagcctccccaacatggcaagagcctgtctctactaaacatagaaaaattagctgggtgtggtggcacaagcctgtaatcccacttacccaggaggctgagggatgagaattgtttgaacctgggaggcagaggttgcagtgagcggagcttgcaccagggcactccagactgggaaacagagcaagaatttgtcacgaaaaaaaagaaaaaaagaaaaaaagaggtatgtttggctcacagttctgcaggctgtaggtgaagcagagtgctggcatctgcttctggtgagggccttgggaagcttacattcatgctggaaggcaaaggggagccagtgtgtcatatggcaagagagggagcaagagggggggggtgtcaggctccttgtaaacaaccaggtctactgtgaactaaaagagtgagaacttgcttatcaccaaggggatggcgctaagccatccatgagggatctgccctcaagatccaacacctcccattgggccccacctccaacattggggatcacatttcaacatgagatttggaggggacacacatccaaaccatatatcactatgggtcaactatatcactatggatccaggggaggatgggataggggaggggaggcagcaagggcattataggcaaagggaagtgcacatatgaaggtgaagaggacatgagcccacagcatgtctggggactggctggtagcttgatgtgcctggaacaaaggctatgcaatcctgggcagcagcagggggagaggtaaatgtggtcggaatgccaacgattttccatgccagtctgtccagtttgggctttaactgtagagaatggggagccattggtgagttttaagtatgaagtgatgggtttatacttgtattttggacaatcctgtgggcttcagagtactgaatggactaaaagagaggctaaaagctgggagacagttaagagctcactgaaattgccaatgatgtcaaatgctgcaaactcatcaaggaaaatgaagactgagaatgagttcattgcatttgacagttggagatctttggtgacatctaaaagtaatttcactataacgactgaagcagaagctggattactaagccagtagttctcaaagtgtggtccctagatcagcagcactggcatcacttgagaatgttataaatgtaatttatctggctcaacccacacccctttcaaaactttgggaatgaagcctagcaattggcatttttacaagtcttctggatgattctgataaatgctaaagtttgagaacaactagcctaaatgactcttcatctcttccccagacgttccttactctgatgacacctgaattatttgatatttcctaagtaatcattaatatggtttctcagttatctgcataaattgttcctgtcagtcatgtgcaatatatgtacagtctctgcctgataatattgaactcattgttcaaggcctaactcaaatgtcacctccctaggaagtctctccaatttcctccaggcagccccccatggatacttgtgcacatatttatgtcataaaatgtatattatttgttgtgttgatttggtttactatcttccctactaactagaagctcttcgggagtagggactgctttatcgatctctatttccatattgtttttacatcttaagtgctcaataaatgtaagaagaggaagctgtaataaattgcagaaataaaaacagaaagggacaaaccactgttttaagaggtttggaagtgaaagatgaatttgaaatagaaatacaatagaaaatgtgtgtgtgtgtgtgtgtgtgtgtgtgtgtgtgtgtgtgtgtgtgtctggaagaaaactgttggctgagggattaagccagtagagagggaaagatgaatgatgagacagtgggaatcagtgggtattgaatgcaaaatggtcctggagaaggcagaagggaattaaatcaatggccaatgctgaagaattagcattgaaagaaggaaagactctttttttctgagatacaacacaaggaagtaaaggtgggtacataagtgatgagttgtgaggttgagatgggagatggtagggagtccttagatggcctgtcagtgtagaaatggtgagggctagggaaggttttgcaggggaggtgatatttgaactaggagatgtctttagtgaagtaggaagtgaagccttttgctgggaagaaaatggggaacagaaagaaggaaagaggctacagcagagaggtgaagacttgtaaatgctagggaggggattggagaacaacagcaggggattcttttgggctgatccatctccctgattcaagacaaagaaagagtccacttattcatccaattgtgattggcaataaaagaagtatggagggattgtccccaaaggctgtctttgaaataagatggacaacttctggatacagatcccaatactaatatagaaagtattctagctctatatattaattaaggctggaatattttgcagacaataacaatgctatgtatggcaactatgtacaacaaaggaaaatatttatggtatatgaattgcctaagaaatctggataaaaactatatgtatgtcggccaggtatggtggctcacgcctgtaatcccagcactttgggaggccaaggcaggtggatcacctaaggtcaggagttcgagaccagcctggtcaacatggtgaaaccctgtctctagtaaaaatacaaaaattagccaggcatagtcacgtgcgcctgtaatcccagctactagggaggctgaggcaggagagtcacttgaacctgggaggtgggggttgcagtgagccgagatcgcaccactgcactccagcctgggcgacagagcaagactccatcttaaaaaaaacaaaacaaaacaaaactatatgtatgtcttgattacaactctgtaagaacatacatatgaagaacaaatgaataaaacacatgaaaatgctattagtggtggtattataggtcatttttcctttaaattttaaattgatgttttaatgtttataattagttggcaataaatagaattttttttccttgctggctttaaaaaatttactaggaacacttagaagagagtatttcaaaataaaaagttgtaaggtgaaaacaatcagtagaattgtatgaacacctcccatataagggacagatgccaggaaaagaagtccttaagttgagccagagttggaagctgacaagcaagaggttggatgccacgatatagaagagcacaaaagaggtatatgacctagcccttgactcacagtaaacttgagagactaggcttacaataaatgattcgaggataacttattcagttatctaaacaacggatgggactggatcactgaggcagtgacctgtgggcaggcgggacaatgcagaggtcaattatgtgccatcggagttgatcagatggacctgggcttaaatccctgtgccactgcttagcagctgtgtgatctaagacaacttactcaggtttcattttctgcactgtgaagtagaaataataataccttctcataagctgttgaagcattacaaacaataaagcaggtaaaatgcttaatacaatgtttgacacacaaaattgccattatcgttattaacgctttattgttgtgtcatctatgagtatttatgatggaggaaactgatttagactaggggcacattgaattctttggagggacttcagggaggtatcttaagagccgtgagagagtctcaggaggcagtgaagactccctcactgctggaacaatgctgtgggctcaccctaggccttcaggaggggagagagatgtgcaaggaggaactccatggtggttcttcttttgctagtgtttgtgctacttccccacttctaaacaggtgcatagtactccatagcaccctttcatcttcctttcccactcttctgttctgtttttcttctcttcaactcttcttacttcccttttctcctcaaaaccaagtggtggatgggtaaggaactatactatcttttgtgtgttctaactttgccgtttttttttttttgttgttgttgttattgtttgttttaatttttgttttttcttgagacagtgtctcactctgtcacccagactggagtgcagtggtgtgatcacagctcactgtaacctcaacctctggggctcaagtgatcctctcacctcagcctcctgagtagctgggaccacaggcacaagacacatgctaggctaatttttaaatttttcatagagatggtgtctcgctaggttgcccaggctggtctcgaacttttcgcctcttgtctcagcctccaaagtgctgggattacagggtgagccactgcacgtagctcggatataattgttgagtagctgaataggagacctaagtcagccttgaaaatcacctgttcctgcttattttcagggatctctttcctatttgccaataaacacattttagtggactaatcatgaatcgttttatggttggcctcacatttaaaatgttggtggtgctcctcctgccctccaaagccctttatggagcacattaacagagccctgccagcgttacaagctgggccccacctgaggttgtctccattgccccctccacccactttactggccacagaatgtttgtgctttggtgttttcatcagttgagttccttttgctcaccaaagaaacaccacaaaagacacttttgccagaaaacctttctcctcccttgcttcaaatacatcactttacaaagagtgttttaattaaaacagcttataaaagtttatgctttggatttttttcctcccagggaaacagtattcaggctgcatagagtcattctacttggtgggatgactgtcctaaagatgtcctttccctaagcccaatttccccaccagagagaagagcctgccagggttgttagggccgagaagatggtctcagatgcagcagcgtgctgggcccattgcagagtgctcagttcatcttctgggtagtctgtgtctggtttcatgccaggagggagagctaaagggaagctacagaagcatccacggttggcaggactgttggacatttgcggcttcagcagggtcaccctgtttggttgagcaggttgtttctgtacaaggcagcgagcatccagggtctgagtcagggactgagatccagactgtgccaggcttgacctatgcctgccatggggctgggtattagtttcctgtggctactgtgatgaactgtcaccagctgggtgccttaaaacaacacatttcttctctcacagttttggaggccagaagtctgaaatcaaggtgtcatctgggttctggaggctcagagggagaatctgttcttagcttctggcggctaccagaaatctttttttttttttttttttttaatcttaaaggttgtcttctaacttcagcactcagagtttacataagtaagcctgggtttaccctacccactttttcccttatttttaaaatatctatttccccaaccattgtctttagtaagtactctaaaatgacagtcatcagcagaaacgcaaggattccaggccataagagtttgatcaagaaaggattttttgaggtagctatatcttgcaaaagaaacagaggtgtgaactgtctgcagggctcttctcggcaatgaggtgttccttctggattcagatatagatcttaatggggtaaacattctaggtcttaccaccatctgttcttctttttctgcttagactgttagtacctgttataagaggaaaggaggcaaaagtgtgaaagaaaaatggttggatcagtggtctgagaaagaggataaagtagtcatgtgacattattcttaacagagattagaatgattaaaaacaaaaacaagttggtatccaggatattcaggtacaaccaccccttacctgctgattccaatttcacattccattccacattgatgaataataataatgatgtacttttagctttgtcagaaatcctatctgcatatttataaggtcattatgtttagttgttgctgatacctggtctgagtccagcaattaccacctctgtctctttgcacacactggtagacatacacaccactgatttgtactttcctataaaattactcttcccctttttaattagagtgttttcagaagcaaaccctatcgttaaggccatgtatgcttccattataaatacctgtttccagccattaattatctcccaatgaattacttacttagaaggagatttttaatgcattttttttttttttttttttttggagacagggtctcactttgtcacccagactggagtggtggagtggtgtgatcacggcttactgcagtcttgacttctcaggcacaggtgattcttccacctcagactcctgagtggctgggaccataggcgtgcaccaccatgcccagctaatttttgtattttttgtagagttagggtttcaacatgttgcccaggctggtcttgaactcctagcctcaagcgatcctcccgtcttggcctcccaaagtgctgggattacaggtgtgagtcattgtgcctggcctgtgcacactttttataatgggatttctcttccttacttttgatgtcccctctctcatacttagttaaccattttgaattccacttagtaagaaaagtttccattttctttttcttcgggggacttagatatgatctgcacctagatggtaagaagattttccatattttgaagtagaaactttctgtatgcctgaatcttgctgtcaagaatgtcttggctaattatgaaggaagaatataagaatgtgagtaaaaacaattcaacagtccctgagaacaacgtcaataaatattcaaaattgcataaccattttagtgactaaagcactgagactcatccaataatactgtggtttgataattacacagttgtgaatttatgatactgttaaattggggagacatcttggtgcatacaggtcaaccttttcatacatcattatatacaaaaagtacacacctacttaggaattgaagtgtaatacctcctagcataaaatgcttaaaagaagattttaagggagtgatacagtgagcattcctatatgaattttcctgcttatctcaagcatagcagaagatgtgaaatttctaggtaagtttttttttttttttttgacagggtcttgctctgtcacccgagctgaaatgcagcagtggtaacatggttcactgcagcctcaacctcctgggatcaagtggtcctcccacctcagcctcccgagtagctgggactagagacatgcatcaccatgcccagttagttttttaattttttgtagagacagggtctcactttgtggcccagcctggtcttgaactcctgggctcaagccatccttctgccttggactcccaaagtgttgggattacaggtgtgggccactgtgtccttccttaacataataaaattgagataatcacattcataaaagggcaaaactatgtcaacaagcccactgtattagtctgtcttcacagtgctgtaaagaactgcccaagactgggtaatttataaaggaaacaggttaactgactcacagtttagcatggctgggaaggcctcaggaaatttaacaatcatggcagaaggcaaaggggaagcaaggtaccttcttcataaggcagcatgaaggaaaattaatgcaggaggaactaccaaacacataaaaccatcagatctcgtgaactcgctcattatcaggagaacagcatgggagaaaccgcccccatgattcaattacctccacctggtctctcccttgacacatggggattacaattcaaaataagatattgggtggggacacaggcaaactatatcgcccatattacaattacttacattactgattcccttaattagagcagaggtaattaattgggtctaggctcagtggaagggtctggctggttcttaattctcagagctagtttgaatcttgaggttaacgtcttgccttctagaacttgtcctgtgtttggctgaactctgtgaacctttcagaaagtaggtctttattgagcacatactctatgcaaggcaaagaaccaactactgtggagtttacaaacatgaataaggggtaagaaatgactcttgtcacatggtttacagtccagctgtgtgggccaccacagttcatatctttcaggctggggactggatgagaggaaagtggactcaaaattaatcccagtgctctctactttcccatatccctgtgctttatctctgttgtagttatgttatttgtatgttggcctgcctcactgctctgtgatctccaaagaacagggactaggttttatttatttctgcattgccgcagagcctagtatgtgctttatagagaacaggctctcaaaaaaattttaaattaaaagaatgtattcacttgtttatgtttcctagttacagtgggccagcttgttctgtgctaatatggaagtgacaagaaactggtgtccctctacgcagaggtccccacactaaatatcatcttggatgtgcttcacattgttgcacaaaggtacagtggagtgagactgagtaagaggacagaaatagtggggggtttgtctcagctcactaattacttatttaaccttgggcaagatacttaaagctctatctcagtttcttcatctgcaaaatggggataataatgactggggtgcctatttcccacgattgttttgaggatcaaatgagataatataattaaaagtgtttttggaaggtctaaatcactgtgcaactgcaaggcattattaaaagaaatcttccttttaattcctgcttccacaaacatctcatcacatatccttgggtccctgggttacatggagagattcgtggtgtagctcaatctatgtgtcatagctatcccacaatctcttcttcaacttctccaacacaccaagacattcttccagtcttgcactgctccccagtttatatagatatatatgttcctcattcagcatttatgtaaaacatatattattgagcacttatgtgatagaaaccggggcaaaacagaaaataaaacagagttttattttgagagttttttacagcttgtcggctctgagaggacagacatgagaacaaataagtgcccaattctgcatttattttggaaggcagttttatgtgagtttaaatcagtaaagacatagatgtatatttttagttttgattaaaactaaaacaattggtagcccttactcatatttttctatcattaaaacttatctttaaaaaatgtcttcagtcatatttttcccttacttccattcatatttactctttacttctcttgtccttaccagaatgtatgcagtaagttttcatattgtaacacattcaacaaaagttatatgtgaacataatagctgctttctttaaaacggttactttgagaaactgcatacctatttttttttttttttttttgagacggagtttcactcttgttgtccaggctggagtacagtggcacgatcttggctcactgcaatctctgcctcctgggttcaagtgattctactgcctcagtctcctgagtagctgggattacaggtgctcgccaccatgcccggctaatttttggtatttttagtagagacgggttttcaacatgttggccaggctggtctcgaactcctgacctcaggtgatctgcccacctcagcttcccaaagtgctgggattatgacataagccgccacgcctggcctgcacatttattttaataatgttgtcatagctacagtcgcttctagagttgctctttggggataactatcttatattcttctgaatatattttaatagtgacaaaacttatctttgcaggtgatttttaaaatttgtatgcagccaagtcactatgaattatctttagtgagtaaagaggaagatcgaactggtaacactgtgggtaaacaactgaaaaataatgttatctttctctgaacatacttgcacaagacaaattccaaaaatattttgactacgttatttttgaaaagggtttccagtatttcaatgtgactactttcactaatgatacttgcttacctaaagtgcttgttaacatgcagttttggaacttcataggtctatgcccatactgacttgtacttgcttagtgttgttttacattctagttcaacatctattatgtgatagacactggggattaataggctgtggtctttgcccatgaggacctcaaaacttagttgagaacacagaaatacaaagagtcctgtgtgaaaaataagtatcggtgttaagataaagaagcggcagtggaagacagtggagggactgtctgttagagggaggaatttattgtggtgtcggcaaagccttctttggactgaaggatgaattatgattagaagttcattaagaggaggagggaaggggactacaggagtcattccaagccaaaggaacaaaagatacagggacagaaacagcaagatatgtttgggggaatctcaagtaatactgttattgtgtgaagttcacaacaggggcagggaggacaggagatggggcccaatgacgaaaaggccttgtatgtaccatgtttagaagtttgaattttatcctataggagtcagggagaggttctatgggtaggatttctcatcccaacaggattgtaaactcccacatccaattagtcacacctccattttttttttctgtttctttaacattgtctcagattcattccttctgaaatctaccttattagttcaggtcttcttaaatttgtgcctggactgttcaccaactcttgactggtcctggggctccagttcacctcttgctcccaacaatcaattttctacagaattatcagagcaatcttcctttccatcaatctcaactctgttcaaaaactttcaatagttttatgtgacctaagaggtagctgcctccccaccctttcagcttgccattcaaggctgcataatttggtcccaaccccctttccgtccttgactcctctcactgctaacagagacagaactcatttacttactcttctgactgtacctttgctttcacgagggctctttcctggaatgatatgtccatacaactattgttgttgttcttacttttagctcttttcttagcccacttgtacccaggtttgatcacaccccctactctcctgccctggaagtaactactattctggttatagtctcttaatatctatatctatatatatgcatccacagataatgtgtagtattgtcttgaaaaaaatatacataaatggtatactttgtctccctctgcgattattttcactgtcatttagtttttaagatttatccctattgacataaatagctatagtcttttcaattactgtgttgcatttcattttataaatataccatacattattcatccattcctctaagggtgggcatttatgttgttttcaaggttttgctattacagtgttacaacgaatatccttagcttagctggtctccttgtcttatacaaattttactgacctttcaagatcctgctttcatcccagctcctctgggaaagccttccctgaatcccccagcccacagcggcaaagtcttggtactcaaagttgcttgtgcatctttggtatcatcccactgccaagcacacagctacgcaaagtaaggcacttaagaaatattcgctacacggatgaacaaatgaatgaatgaatggggcagcaccactccgtgatggctctattcctttttaatggactttggcgccttggcccactttccttctttgacagcactggtcctactccagagcattcctctagctagcaaagcagtgtgtggatgtgtgggtgtaggtggcgatacagacctcactggatgaggaccgcctctccctgcaagttcacgatcccggcaaactccagtgcttgaagttcagagtcctaccccacccccctcacccccacgccccttctgcactggtcaagccagcgagccgctgcagccctgatcgagttaaggcgcggcggcccccggggccgctggagaaggatgcggacggggccagtgactcgtagtagatccctccgcgcggagctcgggccggcgcttcttcctgcgggaaacccctgggtgcccaaggcggcggggccgaggccgcggcgacagtggggcggggcttgcggtgggaggaggcggctgaggcggaaggacacacgaggctgcttcgctgcacacccgagaaagtttcagccaaacttcgggcggcggctgaggcggcggccgaggagcggcggactcggggcgcggggagtcgaggcatttgcgctgggcttcggagcgtagcgccagggcctgagcctttgaagcaggaggaggggaggagagagtggggctcctctatcgggaccccctccccatgtggatctgcccaggcggcggcggcggcggcggcggaggaggcgaccgagaagatacccgccctgcgccccgctctgctgtgggcgctgctggcgctctggctgtgctgcgcgacccccgcgcatggtgagtatcgggctgaggggcgctgtccgcggcgcccggggctgccacctggggcgacccttctccccctcggtccttctctgtgtgggaaggccaggctcggccgccggcgcggagcgaggccactcgctgggttcccgagagtttggacatcgccgggggcccctcccgtggtgccccgccaaccgccggggttccccgccaaccgccggggttccccgccaaccgccggggttccccgccgcctctgctccccgcggcccgggacccctcacacgcctcctcggcaggagggaggccggcagcaagtctcagaaactcctttttcgtagtgccagggtgcagggaggtgggcagttttgcccttcaggttccgcgtttcctggggtcgagcgagagccgacggcgggcctcggaggggctgagcgaaggaatgccagattctggcgtggagagcgggggcagggccgccaagccaaacggcctgcaccttcgcagccagcctcgcctttgccagggggcggcacatgggccgggtgtgtgggcttggtttggatggggacggggttttgcggcgcgcctgagttttgacactccaaccccaccgaaagtccggaggagccgggtgtgctgctcgcgtctttgaaaggtggaggcaggagaagtagggcaactggtgtggctgcatgctgaggcacatgatttaaaaatctcaactgctgttattctttctgaggcgcggagctctgctgctgtttcaggctgtgtccagacccaggaatgtggtgtgacgatcaccaattcctccaacctggcagcagcatttgctgctcctttggcatggctgggggtggggcacgggcgggtgagaaaaagtggatacgtcaattcaaagggcttccttagaaagcttctttgtggttggatgtttctaacacggttggaccaaggaaagggaatcaaatcatatcttccccatcccacccacacttttagattctacatttcttcagaccctttagtggaaataacttgggctttggagccctgctctgtaatcctggattcaaatccagctctgctatatgaactcaccaataaaatgggaatgaaattatccagctaataggattaattaaaataatgtatattaaacggatgacactccaaaggtgttcagaaagtcctttgagggccgaggctgtgttttactgcttctgagattgatgctcccagtgggatggtgtcttgtgcatatttgttgaacggaaagcagccccttctttttctgagcctaatctgaataaagatttttaccttcaccaaaaaactagtacatgaactacatctgttttcaaagaaaaggttaggaagatgatgagcttcagaaaaatatggtctttgttcattgttaacagtcagtcgacatgtcaatcgcagatgtttaaaaagagaacaaggttatttatcacccgaaaatagtactgggttgttcagcaccaactagatacttcttggaaagttcaaatttcgtacacgtctaggtcactaagaatttcagaagtggaccaggaggctttgtagtgatgaagcagagctgttgtttctgaagcatttaataaagagcatatatgatggtgtttttgcttttcctttttctttgagtgaaagctttaagtgtagctttaggatagagaggagtataatcaatgagacagtctgagggtaataatccttggtctatcattaacttgttttggtaaataacttaatcttcatgatatgtagtctcctcacctatgaagcaggactaaaggaataacctgctttagagaattgtagggaataataaatatgattgtaaagtgatttgaaaaattaagtattaaataatatgtcagaaatgggattactctgacacatagggcttcttttattataggatctcagtgcgtaaaactatgccctccacctctgctctgctgaggtgctgcgattattagctagcttttaggtagtcaagttgagtgttagtcaagttgactcaaaggataggatttagatattttgatttttagacaggtgttctttagatgctaaactaatgcagtagaagagatttagaagcctgtttcttggtacaaatcttaaatcttcttagagtctacagtgaaggcttcttgaatcctcctaatttattattgtgttttgctaaggtaccaattacagcacacccttctaaacttttgagtgttcctgtgtttggcttgtggccaattgttaatttaaacatcacggagtttctaaggcaaggagatgttagcagtatgtctgattgtctaaacagctatccaggaccatactcttgctccttgttttcttttgctttgcaatgggaagtgactccctgattttgctgcctgctagataatttctcagctgaattcttctcttgcttaaacaaaatcggagtaattttctttcagatggtgatgaaatttaacctaaaactatttttcctttcactttcttattattcctttttttttggtgtggtggagaggaggaggagagtgattcctagtctctcttatttttctgaatgtttagatttaaaaaatatttacccataacttcttgggatctctctgctccattcccaccctactgcctctcctgtaggcttctatgacatagagaagcaacttttggttcacctggattgtagttgctgacttcaggacctttagagaatgtttaaattcagtgggatatgcttggatggttcagagcagccttacaatacattttaaaaatatcacacccacagaaattctattttgcccacaaaatttgcattgatctagttcccactctgtgttgccattcctagtgatcctcctccctacctctcccattatggtagaaaaaaactctgtgtcctggctacatcaaaatctgttggggtggatcttggactcagcacccagggattctgataaggtaagtttgagaatccatattttttcaaggtttacaggtgattctgacaagtaacttggttgcaacccactgattaagtacattttttttttaccttcaggtgtgtgtatgaggtctttctaaatttaagaaatttccataacaaatgtaaccttagtcattccagtgtttaacacttctgactcaagaattttaaaattgctaacgtaagagatatagaatataatgtcatttcttctgtttatctgggtgcagtatgtctgcattgaccctttagaagggcttcatatatttagatgatataataaattctctacctctccttttcccttttcttctgttatctctttttccttaaatgtcattcatacatgttgttttttgaccctttatctatatacgtctgcaatgattttagagtaaaaaactgcaaggcgtgatttgaataaggatataagaaattttacatcattttctttatattgtgttcacagtccatagttacatgcttcctttcttgatgtctcagttcgaatgcctaaatttgaactattaattttccttccaccctttcctgattttcctgtttttgtttccccccctttctctgcaaatgacttgaaaccaaaaggtcttcttttctttctttgtcagtctaccatatgtgtagtattttggacagatcactgaactaggagccagaagaccagaattcttctccaggtctgttattaattggtttggtgaccttgtaggagagccactgttttggtcctccattttctgatgttcattgttcatggtcacagagccaattagagttgagactagaattcctttcttctggtgtccagtgcctcattcactgtccacattgcttccatctcgtgtacaaatgcgcttatgtgcacaaaaactcttataacatcctcaagtgcttattgttaatgcgtacatgaggaaggaatcgtgtattttcatttatgtgtttattctaatgcccataccctacccctgtacctggcatgatgccttggtatctaataggcacacaataaatacttgttcagtcgaacaattatttttagccactttcttattttggacaactgtggtactcctagacattttaaaaatagtatttgcaggagtcatgcttaccttacatttggggaaaaaccaaatttttcccttccccagatgtttcatttaaacttgtaattttgaatttctttgtgtgtggggtttctttctttctttttctgatcacttctgcaatttataaaggtcactttgactttggaatctcacttcaaaggcactgccatccaccccctgcctctcattcaagtttgcttccactgcttcctgtattactgtattactaggccagcaatttctgttattttgtccagaatagccacaccttattgtaatttcatcattttggggactagtcatttttggaatactatttttaaaattagagttaactaagtttatatttattttgataattttttttgagatttttttcattgagttggatattgcaaacttgtactggattgagagaatatgtacatttagtaaagtatatttgctttttttttttttgaaccaagagagtcccctgaacaccctactgacaaaaactaagggtgaaatatgatgaataaatatttgagagaatcacatggtgttgagttgtctctgccacatgattttgatccttgagggccaggtctgtgctacacacatttcttctctgtactacagaacttgtctggcatgtgccccaaattcagagtcaactgagcggcaggtcttagtcacagcatctgtgactcctgctttcccacctttagaacattctataggagaggctgatggtgagttggagtgtgtttctatgttcttttttcctttgaagagataggatcagttgaaagctgaccccacccacagactttttttgctatctcttttaattaattaaggagtggctgaaattttcctctttgttgacttatgcattggtgggaactttaaaattcatctagtctttctgtccatcccatgctggatctgatgtttacaacattctagtcaagaggtaccatattttctctcttcttgaacatctcttgtggtagacagctctccacagcagtttattccatctttggccagctctaattcttagaaagatcttcttatattcagctgtaatccatctcctcatgacttgtcctcattgacatctactcagaaatttgtctcagagtcctgagacctgtgcaggtgatagggacccaaagagatgcttgtctgtagactttactgagctgacacccagctctccataaaaggagtcaaacccagtgaggagcatgtctggggtgattgctcaggtaaagcatcttagccctacttgtttcatacctccctgcacaggtgggcactggtgggagaataacatttatcaagcagtgtttccctaacctctcttatgataagaatagctcaggtgttctcatggagattctgattcagtgcatctggaatgtcatctgggaatttgtgtgttcaagaaatagccaggtgattcttacattaggaaagttttagaatcactgcagagtgaatctgggaaatcaaagtgtttgtttttgtttgtttgttttttgagagtattagagacaggttgctttggctagatcctgtggtcatttttcccccttggaaatgcctcctacttgctggcctcacttagtacagagaagaaagctgctatggtataaggttagtaaagttgtttgttttgtcttaaaagaaatttgcgaaatccagcattttcggacttctgtttgtgttgtatgactttgttgtaagcctccttattcctccattagaatgttacctgagatgttagaatgcataggagttccacagcctttttggtgtccactaaagaattctgtcctcagccgttgcaaatggtgcttcctttgaggatttctgcttcgttagctcatgaacacatatttggtgtcggcagtttccctcagatgtgttagtgtggagagatataaaggtcactcatttctggtggtcctgcttttggggtttctgggctgctgcagcaaatgaaataaggaaaggaaaataaaggaggaatctagggcttcttgagcagaacaaaacaatctgcaagaaggggcacaggattgctcctctcacaaagacacttgataatactgtccttgataggaagaaggaagtggcttcagatctgaaaggatatgctcataggcttgagacgggacaaactgcatcactggtagtggtaggaggtttgccgtagatctgttttttctcctgtctctcttttttgaggagaatattatctgtatggcagaacatacattgtggtcttaaaaaggagagtaaagccaagaaagggggatgataaagccatagcttggaataagaaaagcaaaggaattattgtattaatttgtgtatgtaaatacataggtttccatgtaattcactggtaggatcactagcccttggcactaacatttgctatctttgtagctctgctgtcttagtggtgtattgggggagcattgtggtgtgttgtcacacttaatttgtgtgcttcccttggcatcatgtggtagcaagtacagggtattctactcttctagatgtgtgggaatcattgaccaagtagaaaatatggtcctgctcccaaggagctgacatcatcatggagacaagacagataagcacacaattaggaatatgaaatacagttattttatcatttatctatgctctctgaaagcagtttcctgcagtcagggtgactcagagctatagggtcttgggagtaaacttcaggtcttaataccaccagggaaaggcgacctccagctcacccttgctgggcttgtctgctgtcgtgagctgtctgccattttcctctttctgtgttgtaatttagaagtattagaacttggcttggggaaaagacaaaaacccctttgtctggtgagggtgtaaatataaatttggcacatgttgtggtgtctattatgtctgttagtgggtttgcggcaagagagagtgctgtgttcttagtcccgaatgccaagcctgaactaggacaagttatggtggaaatatcttccttggaagatgcagttctcagtggcagtggctgaaggaacttctcgtcacagccaggcagtgactgaagtgtggtgtggacacacccagagttgctgcctcaggtggcattgattaatcatactaatatctccctcacccttttgtacttgtcttggcaaaaccctgttctactagctccccaatagtttggcctttactaggtatgattgaacaagctcttgggggttcaccttagtgtcccttgcccctctcgcatttccagccagctacgtcgctccagccatggtaccccgggtcctctggccaggcagtgaggggctgggtttttcttcccattggactgaagcacctttccctggaggcttgcctagggcagtttctggtctctgagtcagttccttctgcaggatactggcagctggcagaactctgggttatttgaatacatcagccaaacatcttgccaagatggactcattgttgcataacgacaggttggatctatgggtgttgcagaacctgtttctgggttaagagtaactctctcacctttattatatatgtttattcatatgatgaatgtatgtgtgtattttgtgaagtaaggaaaacatgatgataatattgtggttggagttagataccttatcctaaatatgttgtctttttaacaaatagcattcctttaaaatacagttgtgcttgatgaataaggtgttgtacaagaagctgtggttacattctaaaataaactgccttgttctgaggcaggcacgttttaaaattgttgtttgcttctttttcatctctttttattttcatctttttttgtgtgagaagattctggaagtttttaagcctcaaatattttcaataatctattttaacgggtacctagcagggagaggttgttctattggtatacctaaccaacattcaaataagaataattgaatactgtttactcactaatctattctgttgagtttctaagtatgaataatcacaaaactagatagtgctgatatattaacttctctaaatggtaaatgtggtaagtagcaaagacatttttgtttaattctctccttacacatgctttggttcagacgctgtcaagacacattgaagtttgaggacatgtgtatttcgattattttattatatttttatttgctgtgaatatgggtttatttatttgctagatcttctttagttagaaacattaagggcatttactttattacaacatttaaagtgcattctaatcttcatgaggaattttaggtaaaagaccgtatcctgagattcatgcaagtctttggcattatgttactatttaaagtaagtaatatgtagtggcttctctgacatattctttctaagagagttaaggaaaatagttgtaactaaaagcaaacattgaaacagtttaaggtaggtttacgtagcaacagaattattcgttatgtttacagataattaactcatatttatactttgctgattttctctggcacctttacaagatttttttatttttgtaatataaaaagtaattatgtttgaaaaagtagttaaggatgtttgaagaatctagaaaagcataaataaaatgtccacaatcatgctgccattaattttttggtatacgtctttggtttttttacccttagatttagaaaagctgttgatttatttatatatatatatatatatatattttttttttagtttatgaacagatctacatatatatatatgcacacacacataatatactattgtcaacactaggttttatttttaaaaatctttaccatttgataagtggtaaatattacttaatcttaatatgcctctctcattacagtgatattgaatgttttttcatatcatcagtggcgtttgtattgccttttttcctacttcttttgtaaattgtgtcttttactcatttaattattttcttactggtttgaaaaagctctttaaatattaagggtgttagtcttttgtcttaaatatgtcacaatatgtatggaaataattagcagtatataacataacatcaaattgctaccaatgttgatataaaaattgttcatttcataggttaattttttttaatcctttggtttctaatgatattggttaattcatttgttaactgctattttctgtagctacttgaaagttcttatctgactgtatcgtaaatcagcatgctttcagctgtatatgtctaggaaattgacatttactttaatacttaataaaaaaatatgttggagaaaagcagtgtattctggagtcaaatacatgattttgggtgggtgacgtaatcggctactgtcctccttttctagatagccaagatttttgaagcatttaacatccctgaaaggcaggactaatgctatgtctaccatgcactgctaattctgacactttgacctaatggataaatgccagtacagtgggtctagccagttagcttggtcagagaacaagatgactaagattctctccccctttcctcaccaaattgattagttgtaggacagaactgactgaagcaacctgttgttttggcaacccatggacaccacctgtttcttccattcctccgtccagcctctcactgccctagtgcagtgctgtgtgcatagtgggtaggagatcaatgttgttgctaaagaaagtagcaataaagaagagtagattgctttttttccaagcttttgtgtttttaaggcaccccgctggttttgacattcgttgctccagctgaactgctctatgctgaagccctgcaggtctcaagtgtttggttcagagtaatttcaggccatatgaatgctttcttaagtatcattggaatttactgggctggctgtctgccagctattaccatatttagcatgaagagacctggggaatgaggacatttctgatcaaccaaggaaggaaacctatttgaaggattacaatattttctttttttttttttaatggtgtagttcagaaaacgccagttagactgagactcagatttatgtccactggtctttgtttctgtgccccatcccaaaattaatttatgaataggaaaagagatttgatagtgaagttctttctcactctgaagtctaatactgtttctgggaggaagtaagagaattattatgcccacactgtgcactgagaggcttaaccagcaggtgaagctgttgattaaaaacataggttgatgagtattctcatttttctcctttgaagctttcagaaattttctgctttgtcctggtctaaatttattttggcccagcccttgtctccaccctacatttcaaaccagtagccttccctctatggctcaacatttctctgcctcagttttttccattttaaagatgaagatattgtttggaaggaccagtaaatacaattaatataaaaattgcttctgtagaatcaaacaacctccaacatttctgttggaaatttatagtttatagagtattcttacacaatgatctcctttaatcctcacaaacttggtggaaatggagcctcacaggggctaggtgacttgtatacattgtttacccctacataataagtgacagagctggtacttaaacttgtggcttgatttttctttttttttttgagttggagttttgctcttgttgcccaggctggagtgcaatggcgcaatctcggctcaccgcaacctccacctcccgggttcaagtgattctcctgcctcagcctcccgagtagctggaattacaggcatgcaccacaacgcctggctaattttttgtagttttagtagagacggggtttctctatgttgggcaggctggtctcgtactcctgacctcaggtgatccgcccgcctcagcctcccaaagtgctgggattacaggtgagccaccgtgcctggtccttgcagcttgattttttaaacatcagatttttttttcttttttgatttttattattatgtgtctgtcattctgctaggggctttgcaaatattgctttatttaattcatatggctatcctttggagtagacaatatttttctacattataggtaaggaatttggaacttaggttcacagctttggatgttggcctatggttagtgaggggtgtagccagcattcaaacccctgtctggctctagggccgctgcaataaatcatggtgttttatgtacattcatacacttaacactttgcaacaaccctaagagacaggggtaggtatttagggaaactggggcttctaacttgcacaggataatgcaattagtaagtggcttagtcgagattcagagctagatctgtctccataaccctcactcattccaggatactgcagatgcctatttttatgatatgtataagtaaaaattaatttaaaaaactaccttctttgaagggtcagccagttagaactcttttgtatcttctgaataagtaagaagtggatggacattagctgaccgatacattgatggcttttaaccttctatcagttgatttccattaccaggacaagcaaatataatttggagggaaaagaggggagtttccattaaggatgaatctttaagccgaaaagggccacagtgatgaactcttcagaggactgctctcaggagcaatggcccttctcctctgggctctgcttggggcattcctgtttgtatttatggagacatctttttgaaaggcagatgccagctttggtggggagaaggttggaaaacatacaagccttgctctaaatttactagccccgtgtctttgggctagtttctgaagcatggtgtgcctcaattttattattttaaaaataaagatagtagcagtatattttggagttgttatgaagataatatcagttaataaatgttagattcattggacagtaccaggcacatagttaaagtgcagtaaatagtagttattgttggtattggtgttattttatgttgcagtacagactggcttcttggtgcattcacttttctttaatcaaaagtggatgagtgattgggaaccttcatgaggaaataggaacatcatctttgcagcctgtggattgttcactggtttcctgtgatctaataattatttaagggtttcatatttgagtcttttcccttaatgaggtacactttcagtttggggagattttatctataggcataccttattttattttgtgttcccttttattgtgcttcacagattttgttttattttttacaaattgaaagtttgtggcaaccctatgtcgagcaaatgtatcagcaccattttttccaatagcatatactcactatatgtccctgtgtcagtattttttagcaataaagtatttttaaactcaggtatatgcattatgctttagacataatgctgttgcatgcttaatggactagagtatactgtaaacataacttttgtatgcactggggaaccaaaaaatttctgacttgcttcattgtactgtttgctttattgaggtgagctggagctgaagccacaatatcacaaaggtatgcttgtattatgcaagttgcattgataggtgttaaatcattttcccaatttttattaaccacacatttgtgattggatgttatgtttagtaaagatattgtgattttctgaggtacagctttgagaacagtatcaggtctaacactcttgtttccaaatttcctatgatatgacaaacataatcacatgccatccagtgtcaccatgcagagtactaatgtgaagccaaaatacttggtgttttaattagccttaaagcagttaatgaactatctctgttagacattttgaaataataaaaatatcccattgtcttttattacaacctcaggggctcctggagattttgggatcttgtgtggggaaccacccatctaatccatccttgttttaaagagagaaaaccaaagaagcaaagtgactggcccaagtacctagagctgggtcagggttggggccagaatccaatctcttgacttttagtcaagtgatttttccactatgctcagtactcaaattatgtatcaatatgtcggcccttgttttttgaggtctgaaaagggttagtgccagtcaacaacagtagaggagtagaaagggtgttgggatgggagaggtgtggctatatttaaaatttcaatgacagcagtgaaaataatttgcctgtgaacctctgcctgtccctttggacttctttgtagtagttgagacagcccggcaggtctggtgtcattagtgattcagaattggattaacctggactggtggagttactttctcagaaaagggctttatattttaacatttgtttcccttgacagtttgcttcttctcaagttttggcagccttgaacaagtggttgtcaggtttttattttgttttgttttaagaaaaaattccaaattttattttgccgatttagtaagttatcctctacctgccactcccttctgctccctctataattatttctaagactttatttttccattgtgggaacattatggaaggttttcttttacagtctgagatatttataattatgtgtaagcacacagtttatagaatatgtaaatggtccatatgttaacttaaatacccttaaaatattttccaataatttaaatctttccataaaagtagctgaagctgcttataataaaagagaagtatacacgaaggatagcagaatttggatgtagttaatatagataaatatgaatgtcactttggaggaactggaagtatttgcatgaatactgatcaagtcatgcctccttgttaatagagtgaacaaaacagatgaatgtttctgttttcatgaagtttatgtgactatcagtagcttccatattctgagggtttattatgtgacagatgcttggggacaaaatactttacttgtttcctttagtccttaaaatagatgttaggattcttgtttacagaaaagttaaggaatgttcatccagatcacctagccagtcagtggtaaagaacagtcactggaacccctctttcctgatccaaagccaacatacttaaccataataaataatgccattgtctggtggaatcctgtagtcccttagatagtgtaattttgtatttaatgtaaacattttgtgcactaaactgacttacattttactttttaaaacaatattttaattctgaatgaacatttgcataataggagaatgatctaaattgcaaacttccattttgaagagttgtagttcttttaaatctttttgtaactgggaagaagaatggaattatgtttgttgtaatccaaggaaagttggttagcattctttcctgttactttttgatcccaaaagaaattctttagtagattaagaccaggaatgaatgtgtggatttttttaaataaaaaattgagagagattgcaactagcaattcagagccagatttatgttcagaaatgtttgatgccagccgttttagttacaaatagctttttcttgactgtacagttgtgttcttatggtaccattctgaaagtgatgtaagagaccatgtaaaatgattggaatgcctcagcatctgaacaatgcacatagccaattattaaaattacccagtactaacctgtcttggcttaggaactatgaaattaactgtgggtagcatttctacacatatcattacagaacaagcataaagacaagcttgtttttttccttttctttggatttgttttttcttattaccatatcttttgttactgaaaactggtggtcatctgtactaatagataagagaagtgtgtttgacaccaatacctaatcttagattatccctgctattttaaaacacagtccttcgcctgcatgctcagacatgtgggttctttcaaacatactggacttcctccttaggttttagttgtgttagtcaatagttgaatgttgaaggagaggatgccaagggatattaaagaaggtaaaagagataagtgacagcaaacattatttatttttaattatctctcagaatgacttttagatacccttccctactaccttttgatttttgctttagcatagctggtgagttttggaatcagagagactgggctctgatttgtactagctaagaatattagacaagccacttaacttctttaagtctcagtacccgtatttatataatgggaataatagtaatatctaacttgcaggattgtttgtaaagattgaaagcaacatatttaattgtgcttgcgtggttctgggcacagaataggcacccgagtgtaggggcccctgaactttaaagttcattactttcatggtaattcctcctttggaatatatagcctgggaacatttgtctctagaccttgtttcagtttcttttaatgactccctttaggctctgcttcatggccaatgcaagattatggatcacctaaagagtagactaaaagtactattgtctagtaacttcaagtttgtaggttaactcactgtgaatcaaaagcttttaaaaatcttttgtgtggtcatagtttgtagtgtcttgtacctctcatctcagaagcaattgattcatagaaaaaattatttaggatttcagattaaagatgaagaactctttcaataagaaggaactgatttggttggattatttgtttctttcacccctgagttttcatggaaatcaggtttaaaaggttagaagcagttggttttcagcattgggaaagcttatctgatcaggcatgcgaagtggcctatgtcggatttctgagctaggaaaggctaggggaggttgaggagattattgtacttgtaattcctgagcatggttgagacacaaggagaggattgtggaaattgtttttaaaaaattgttgaagttaatgcattcttgggtggatttgcaaaacagaacaaaacaaaaagttgttgaagttagttacactggtctaacaacgtatacttaccacccccatttgggctggaggaatggatctaataataatataggtgtttgtgatctaatttgaatcatgtaatcatttatcatttctgggttagatggtaaggattttctgtttcacagatttttagactgggaattgtgctattataaaataatattttacattaaataatgctatctaggttgtaatcaccttaatagacatgatttatttgggccacaaatgaactctggtaagaatggagggctggttacattattttagttttacagatgaaaataatcagtctcaaatagcttaagggaattcctttagaccatatggttagtatatggaaaagccagagctagaacccaggttctgatttccagagcagttcttatttcatgataccgcataattttataatgtccctaaatccgaatttcatttctcatgatgtgaaaggattctctttatttctgtttggttagctgcatcagagcatgacagaaatggagcagaatttgagtattctttccccagatgggtcagttagcttttcttaaagctattctgtgcttacattgttaatcagttgtccctggttcctagacaggatgttgatacatgtgaaataggcaggaatatgtgtctgactcagcttaactcatcacaactttcatatgtcctgctagtgggtctataacgtcaccctcgtttacaggcgtttttaattttctgatgtctatttcttagtatttttcctcagccatttttaatgtctcaagccatagttcttcctgagtggcctgaagtgattttgctgctctttaaagcttccttaaggtttttcaagagcgtacaacataggctgcttctaagtgtatttttatttcctagctcttagcatttctcaccttatcattataactttaaatttaaacagaatacaaattgtgtacacagatggtgtgtcactattgcactgtcacttatgtaagtgcagtttagcatttcttctttccttttaatcaaaatgaggaaatagaaaatgttttgttatggtagttttacacatacacccacaaggaaatgtgtatctagagtctgtgggaactgtgactgatacatttcagggaataaaatgtatgatggctaaaattttaactctgccaaatgttcacggggaaagaaaaattaacaaactcacattttacactttattttagcctagtctctgccttgtttacatctatatgataatgaagctatacttgtctttccacaacagtgtattttataagttgtaccttttgtttaagggagccttcttaacaaactttctttcagttgtccagtgtacagaagcttactggaaggagtggccaactagttaaaggtttgacacctcaatatcaacaaaatgccaagtggatcattttgactctcacagcaatccaactggacatttgaccatgccccgtggtcagtggagagcttcttctctgaaggccacttttatctagcacatcaaggctatacacctctttcactaagaagaatttgacacttttatgttgtgagagctgagattcaccattctccaccatcctgagaagagctttgatagaagggctactcgtgaggtacatagattatctaaaatacatacaattttttcatagaaaattatatatgtattataatttttattcacgacaggttgaaattaatagatttcttacattcactgcattaaaggaatatttatggctttggtaatattttaaatttcaaattaaaaaatttgaatatctgaattaagtatctctgatttaactctgtgtgtgtgtgcgtgtgtgtgtgtgtgtgtgtgttgggaggaggaatagaccttggaattgttttttcaaaactttttttataatagtgcctaatctcagttggcaaggaatagctgtccagaatgctgcatagatctagtgaaaagatttagggaagttgtaactagtttaataaccatctgtggagtgacatagattgacacacccaattacacaagacctgagtctgagaactgttgatgtgcaatcatcccatcagcatctgctcgtcattatcaacaacaataatggctcaactatttctttgaggccacatgaaaagacagtgtacccatagcaaaggataagtcagacctgaaaaaaacatagccctctgcatccccttgttcccaaacttctttttaaacataaccttttgtgaagttctgaaagaattcattttatgttttctttttattaatttttcttcttaaataccatgtctttctggctgaaatccttgccaaaaccaggaagggccagtgtactgtgggtgatttttctaattcatttctttgtcatttgaagccttctgtggcttcatgctgctttatgtgtgtgtaaatattcagtatcttttctagtttacacttttgtcacaactgctattaagccacctatggacacattctaatataaattattttggccactgtgagtgggagggaaagaatcagttcacagggataaatttgcatgttgagaagataatatataatagtttgcaaaacacttctatgtacattgtatcttttatagagacaaggccatgtttttatttgtggagactgagacagagaccccatgagatctaatgcagagtcacatgactccaaagccaggtcttctatctgctctttggtatataactggatcattattctattgacagaaataaggaatcttcttatttttcaaaggcacccttttgcccttggaaggtatatttagaaatcctttaccagactagaaagaagacagttatattttcctgccttttgataaaaaacagtgtgttttttctaaatcttgttgtgtttgactagagtctgattaaggtaccttttgggaaattaaggttctatagaaattactgggctcaatctagtgatacaaatatgtgttgtttgatttatcaacacattacaaaccttaactttggagttttaatatctggttatctttaatatctggttatcttctttctgaagtgtatgtacacaaaattgatgctaaataaggtcttgttgttttggcaaatagtgaaatgcaaggtattggtagatcagtactgttataactttggtgcaaagttgctgcatgcagattggctgtgggaccttgttcattttttgagaactaatgtagagtttgaaaaaacaccgtaagcctgcattccagaagttctggtatggatagtgtgagcccagggaatgtgcttagataaaagatcatttaacaaataggttttgcatttttttagcaatcaggctttgtgctgaatattagagtggttgtttcagagagtttgcagcaattaggctttattggtgcactaaggagaagcagagaggagaagcaattcttggtaacttccttggaagttgcagctaactctgaaaagtctgggttgaactaggtaagtaactaattcctagaatcaataaactttgcaggagtccgtttgattgtacatgtagctccctggaattgctattggtccctaaatcatcagtttgtaatgctggttttcaaacttgagtgcacatcaagttttggaggacttgttagaatacagattgctgggctcacccccagagtttctgatctggtaggtctggagcgggacctggtagattgcatttctaaaaagcatccaggtaatactgctgctgtttgggaaagtacactttgagagtcactggcttacagcaatctcaaggtgtttggatttttgggcaggggtgctgtgcaggcgttgctgggatctcttcacagcacctccactgcatagaggtgagcctccagatgttttcattcattcaacaaatatatgtacctattgtgtgctgggcactgcttaagttgcgaggggatattgtgaagaaagtaagcaaaacccctttgtttgtagaatttcagtgagcatagtcctgggttaacctgacaacagtcctactgtttattgatgcttataggtgagcctatttctctttctagctttcttccacttaatttactttcttttggaattcttgaatttaataataataatattgatgttattagtcatcactataactttttattgagtatgtattttatgtcagacacagtgtggctaagtgctttacatacattatctcatctaatccttagaaaaaaccctggtgtattagtcttaatttaaaagatgtactttggaaaggttagtagtttacccaagattatgcagctagttaaaagtggtgctggggctgggcttggtggctcacacctgtaatcgcagtgctttgggagtctgaggcaggaggatcgcttgacaccaggagtttgagactaacctgggaaacatagcaagaccccatctttacaaaaaataaaaaaattagccaggagtgggggtgcacacctgtggtcccagctacttgggaggctgaggcaggaggattgcttgagccccagaggttgaggctgcagtgagccatgattatgccactgcacatctgtctgggtgacagagcaagatcctgtctccaaaaaaaaaaaaaaaaaaaaaaaaaaaaaaaaaaaaaaaaaaaagtggtattgggcctgtctaattgcaaagccacattctttactgcatgctttagtccattgttttttaaactgcagatcatgaccacgaatgggtcatgaaaccaatttggtaggtctccaacagcactttgggggaaaaaggggtagaatagagagtatcacatagtatggacaagcattgtttcttgaaatttttgtttttgctatgcacgtatatatgtgaatattgaggtctggtacaagatatatttctcactgtaggtcacagtaaaacatgttggtaagctactattttcttggctatgggactatatgtcatctaatcactttttaaaaacagattacaaactgtaggccttagaaaggtaagtaatttttcagctgggcatggtggctcatgcctgtaatcccagaactttgggaggccaaggcaggcggatcacgagatcaggagttcaagaccatcctggccaatgtggcaaaaccccgtctctactgaaaaaaatgcaaaaattagctggacatggtggcgtgcacctgtaatcccagctactcaggaggctgaggcaggagaatcgcttgaacctgggaggaggaggctgccatgagctgagatcacgccattgcactccaacctgggcaatagagagagactgcatctcaaaaaaaaaaaaaaaacaccaaggtaaagtaatttttcaagagcacaaaaatagtcagtggcagtacaaagacaagatgactgacttttttttttttttttgagacagggcctcactctgtcacccagactggagggcagtggtgcgatgttggcttaccacaacctccacctcccaggctcaagcgattctcctgccttagcctcccgagtagccgggattactggggtgtgccactaccacccggctaatttttttgtatttttagtagagacgtggtttcaccatgttggccaggctggttttgaactgctgacctcaaatgatccacctgcctcagcctcccagagtgctgggattacaggtgttagccactgtgccaggccagatgtctgactttttagcccttggtccattgctttattcttcacaccataccacttccttagaagtgcacctgggaatgcctgggaattgaattttatctttccacatgatggcagatatgctatggaaccttcagggatgtcggtgaaacctgaaaagggaagttgaatctcagcctgctctgagtaggtgaaaattctgccttggatcccccaaagtctgcagataaagatgtgacatttctcgtgttctgctgtgcttgaaggaaagagggtaataatcttaacagtgccaagctgtaagcatgttgcatatattaacttgtttaattactaattattttgatacagcggccatgcctgggatatgaactcagctgttttgagtgagaaggggcatcctaccagtgtgagttaacacttctctgtactctccccggttcctcattttgttcctgctgagttcagagctatgttcctcatagcctggcttacctgtggatgttctcagcctcattttcttttgctagatcatatatcttcattaggtgggtgattttggtttctgttactttttccttaatattagtatattgctgatttggatcaggggccaggctgtagattttcagcatggtgaggtgataatacatgttggtcccccatgcagaatgctgcctctagcactttagccaaaggagctctacagtctgtccagaagtactgggggacactggtaataacctgagaacacttacagagccttccagaaagtgccctttcacatcatataaacagatcatgggaagctgagggaatgcaaagtcaaggcctcattggagagcggaaaggaggctgagattggtggagaggagtggctgttacattctaattagaagaatgacatgtgcagggccatgaagcaactaaagatgggatgaaaaacttaacttgtgaatcgcaaaatttgagtaggaaggagctggaaaggcctggaagtgcgaagtgattggcccttggtcagatggctagaagatagagagccaggcatagaacccagaatccaggccatcattttgtggcctcttttatcctaatgacgttagccagaggtgtcttccaaagcacctgattatagggaagaatgaatgtcacttaccctagagtgagtgaaatagagatgccaggaagatataccaggtttatccagtttctttgcatttttctggcatactgtatactcttgagcgcatatgtatcctactttgtgaaatctgggggtaaagcaggacccttcaaacccttaaaaaatgtataccccaagaaaaacatttttaaagcatgaacgcttcctcaagtaaatacatatttatacattatataaatgtctggctattaaaccatgtatgcatatgttaactctaagtaaagcttattatatgttttttagcccataaatatggagatgttttaaaatttcttccagtgccccagtggatgatcttacacctcccgtgcttctgggatacacacatctaattttgcagaccactggtccagaatgtaaattgaagagtttaatgtctaagatatttgttcttttgtttgtagcttatcttttactccccacgtttcaaatatccgtttgcaaaataatttttgagttaaaattttcaattaaaaaactgtatccttgaggtagaaaagataaagatagaagatatatgtgaattaggttgtatctctccttaagagggaatactgttttttatctaaggagaactaacaaccctccctttcattgtctgggttggtataagtaaaaatccttgtttgaagttattaagccttcccacccatatgatgattagtttggttcataagctagagttagggcttggtaaaggctcctttttttttttttttttttttttaaagtctttccaccttaactagcaagtaagctagaaatgacagagcagtagaagggggaatctaccagagtgtcctacaggaccttgttgaatgctactgctgcatgcaagggttgtggatttggtgtgggccttctgcagtatcacccaaatttgagcagtacatgtaactaaaagtaagaaaaataaattagacagtttatttcatttcagactttggaagcccaggactgtggggattagctattagctaagacaatgattcactgagcaaatgcagtgaaagattcttttgttacactgatcatcatttgtggagagactctgaagaaggataaagctctggctgcatagtcaaaccagacctactactcaaggacatgcatactagatatgtaggtgtttccaaatatttttttcagttgtgggggtgcaaatcatttcaatagtagagtaactcagttcattactgttactggaaaaacaagtttaaccaagcacatatcctactgagggtgagtcaacagtgtcattttaacataagaaggacagtacatgaagtgagttattccaagtcctgtggttttcctacagctgagcaaagacagctgttctttcggaagtggggctctaaaaagaagttgcccatctcctttctttcttgattatagccttttagttttcttttggcctgagacatttcaaaaattcacttcctccttagatttctatcaccaaataccctgaattttgataatttatttatagagtatattatttattatagacttattatagtttaaaactttattttaatttatctcccatttcaagatccacgtttgctatatgtgtcagataataaaaatgccataaggaaaacagaggagtgatcttttttaatatgtcattattttctatagttctttagtggtatggacatggaataaggtggcattttgtgggacagtataccaaacttagtgataaaatttatacttttaattttggaggacaaaagtcttgtattctcagccttgtggataagacagtgctctgagctgtctgaggtttcctaaattgggattcaacatcatgaagggtatgtgtctggatagtttatttgttggtttgggaaggtgagtttttgtcttttttccccctctgagttgatttctttagttggagagaagcagaccagatgaagaaaatactttatctcttatggcatttttggtttaccacattagtgatgacccgtcttctctgagcagcaggccatgcttctctgttcagtagttcagttttcactaacttaactgcagatgtgttcttggagggatttatttctaagcaattgaattatgggtacttggataaaatgatgatgggttacctacttttaatagggccatcatttttaagagtaaaatcttgtcaagatagggtatatcatacttatgatctggttccatctctaactccataatttccttgtgctcctgtgttgctactctattattgagaagagatggtatcttgtcagtgtcaattttacaaagaaaaaattctaaacaatttcagtcatagggtagtttttttttttttcctggagaaataatgcatagtgtagtatgttgaatcctagagttggcaggttttcaaaagtggggttcttttgttgtgtaggtaggggtgatgctagtcaatgggtgttagtcattagggcatgtgtatgagtggtagttctgagatacagcattggcagcccctcttgtccctggttttgtttttgataagcaagtcctggttttgttttaataagcaggtcattagctgatctttcgtgtaaatgtttttgatgtgcatagctggtatgtgggtggttacctacctgagaatgttgtagtcacaaatgtatattatggaagtttgcagattatggtggatatcaggtttttctaactgcgtatttacagatgtagtgagtgaaaggaatgttgggtcagtaggtaaaagacttgtgctctggtcctggttcagacatcttgatttgtgtgactttgggcaagccccttatttctttgagttgcagtttcttgtgtaaaatggtgctaataccaatttacatgcctcatagtgttgttgtggggatcaaatgagatcactgtttatgagcagccttctcaggagtgagaaatagagggttgtgagctgactttctgatttgtttggctgaggtgttcacacaagccatagaatgctttgtaggcttgggtggaggaatgtagatggaaatcagctgaaaatccctgcctattagaagctgagatgttaatcctaaatatattctatggagtactatcagatgccttgcttttcttcatgatgccctattagcttcatcttcaggtagcataggtgcctgttactctcattttacttgaagaaactgaccagccaactgatttaggatatggctggctatcttctggaactcacattagagttactccttgagagtaaagtcttgtattttctgaaggttgctgcttttggggtattttccgtggaggtgggtgggcacacacaaaaactcactgtgctcaaatttataaacttgttcttcttaacaattttaaagccagattacattggattgggggaggggaggatactagatttagtgttttttaatataaaactttgtatttgaaactttatgtggtaacatatatttaggctcatagccaaagtgattacaatgcattggttttaatattttcagtgaggtaatgtgtgctttagtggggaggaggagaaatattatttaatcaccagcactacactaataaccacatttactaaatcctttgtccctttgcttgaactgagggttccttgcttttatactggttttccaaaggacttaatcttgttaatgtgatgaggtgatgatgggaaggacattcccactgggcccgaagtggtgaaactggtaaaactccctttgtaagtccctcttgttcaacatgagtgtcactcccatgtccctaaagtagaatggagttttattgaagagagaattttaagagtgataaacaaaagagatggaaatatctcctgtgccaggtcattgttaccattaaagactagaataaactgtaattttgcagattttctttttgtcttatgggaaattaaagacttggttatcctctctcggaggaagatagaaaactactgggcctgctcattaacagtttagcttggctgacatttttcaagcacttaccatggtattatagctgggctgaagctaggtggagcagacctcacttaggtgttgcctagctccagaatctgtcttctggtggaattcccttaggcttccagacaggagtggcaacaaagcagatgaaatggaaggtaggccagggcatctgctcgttcgctcgctcgcttgctctttctctctttcccttttctttcctttcctttcctttctctctctcctttctttcttttgcttccttcctctctctttccctttcccttcctctctctcttttctttttttctttcttttttttcttttcttttctttcttttctctctctctctttctttagcagtttattactcatttgtgagaatcagggaagcactgggctcaagaaagccaataccccttctagggcttaccccccattttaaaatttaatatattggaatttatattgtttcttttgatccgagatcttcaggctgaagctggagagaaatcttttgacctctctagaacaaagaaagcctttatcaaagacaatgtaactttttgagtttgccaaattaggtgttgctgcaaatggagaaacctagagttctcttctgtgcttaaagacacaaacatggaaagttttaagttccaatatggtcacttaatatatacaaaattttctgtctttgctgtctttgtcattccagcaacaactggatgagcaaatagaatgattgtgagcacttgcaaaccaaattgtgactgttagtgtgttgagctgcttttttattaaaatgactgctacaactctgcagaaatctgagtagtcttgaagataaattcttgcttgcatttacaataaagaaagaatatgagtaatcaaaaggctgatggagttggaggactggcgtttttaagaggaactgatttggacattgagattatcagctcctcatcaaatatcattaagtacacattattatttttttctgttgaccaggagacccaagttgtgttgatgtgggacatagttgtatgtctgaagaaacaaagcaagggagaataaaataaataaaaattgaagttcaggaatatatatatatatatatatatttttttttttttttttctcaggcagagtcttgctgtgtcgcccaggctggagtgcagtggcacaatctcggctcattgcaagctccgcctcccgggttcatgccattctcctgcctcagactccctagtagctgggactacaggcacccgccaccatgcccagctaattttttttttgtacttttagtagagatggggtttcaccgtgttagccaggatggtctcgatctcctgacctcgtgatccgcccacctcggcctcccaaagtgctgggattaaagacatgagccaccgcgcctggccgtttagggctatattttatgttttcttctccctttggtatttaataaagatttgatatttttctattatctgctttcctctgttccaaggtttttggcctcaggtgtgttctctggaaatggcaatgataggcatttataatctccatatttagatatttccctcacagtgctagtttctgagcttattagaacctaatgttaaatgacgagttaatgggtgcagcacaccaacatggcacatgtatacatatgtaacaaacctgcacgttgtgcacatgtaccctaaaacttaaagtataataataaaaaaaaagaaatatcctggctatgagtcaagggtttaggaccttttgaggcacttgggtttagacaattctcagtgatgtgtacaggaatttgggtacaggaatactattcacaggtgaacagagtttgattttggctgaaggcatattatttgatccagataataatataaaaataatccaaatgttaggaccttagcttctgcgaaccctgacttgagaatagttagccatacatgtagttggactttatgtaggactaaccaatctcctctgcactatttttgcacagtacattgattatggtatccctgatgacctctgtccccatccttgtgagtagccttcattgctaccacccaaggatgttttaaaaaggctatgaggaaggatgcatgtagggaaatctgaggttgttctttggattttccctgttttgttttaggaagtatccatgattttatataataatatgtagcaatcttaggtttttccattttcatttttaacataattttgttattcattctgtttgggtgtctacctctaaattaacaaacatgagaaattgtgtactccatttaaaaagtgtcctgagcaatttaagctaaaagaatatgttgtttcttttgtgtgtatagcaagaagattatatatatttataaatttttttccagcaagtgtacttaaaagcatgtacttaaaattaaggacttaaaaaaactaagctgtacttaacaaaataatctttagaaagctttaaggccgggcgcggtggctcacgcctgtaatcccagcatcacgaggtcaggagatccagaccatcctggctaacacggtgaaaccctgtctctactaaaaatacaaaaaaaattagccggttgtggtggcgggcacctatagtcccagctactcgggaggctgaggcaggagaatggcgtgaacccaggaggaggagcttgcagtgagctgagattgcgccactgcactccagcctgggtgacagagcgagactccatctcaaaaaaaaaaaaaaaaaagctttaaaaagggagtttactaaaagcacaggaaattggtgacaggcaaaatttgtcttgataatagtacaaatacagatagtggaacagaacagataatacaagatataagacaagacatggaataacacttcatattcactttctttgaccactaagcagcacacaaatatatagcactttttgtagagaataattaaatttctagatatgatacagcttcttcctctctgttgggttttattacactgagatcctgaaccttttggacatgtaaactgtgatcatgttggtcagtgtcatttggatctcgttggtgcttattgttctgccgatgtgtattagtgaacctactcatggggaagataatactatacaatgaattttcccattcagttggaatttttttattactctgttttctatgtttttcatttagatgtaaattattttggcttccattcaacctatttcagctagtttttaccataatacacatggcttaagatttataggaggctaagagtggagagtgtatcttcattcaaacaaatggtaagaaaggaactttcaaaactgttttagttttgcaaagattagaaaagtacaattctactttctcaacttttcatccttgttaaaggcctggaaatttgcagcatttttttctttcttattttacttttctaatttgttacacaaagtgaaattccacacataaacatgcaagctgaaggttgggtttattcataggttttgtcttaattatagatatttagtttattgaatatcttattgagtattgagtacctgctgtggtccaggcatcttcttaggtcccaggtgtacaaagaggagccaattgtggttactgcctctatggaatttgcctagaagtgggagagagagagatgagtgagccagcacttataatacatctacctaggataaaatgggagcacagaagaggaacatctgtatcagtgggtctctgagagcttcttcaggaaaataatgctttatctgtgatttgaaatatagtaggaatttagcaagatagagaaaaaggaaaaggaggtaaaatatttttcaggtaaaagaatgtacatgggtatagaggtgatcattattagcaaattggctacatcctaatttgtaagtatttgtggatttttcaaaccttatatttcatgtagaagagctgaatgcattagtctcatctccaagatccaggtattgaaatttaacccatgcataaattgaatttttttctgaagtctttaataagagaaaaataaaaggaaaaactacacagtgtatagtagatttcaatatagcacagcaaacactgatgaattttttttgcaatgagttcaatattataaaatagaacaaaattggaatttttaaaaccaaaaattattctagatttatcagctaactggaatgatttttttatagtatgaaaagtctgttagtaatacaaaaaatattcatttataagttgttatcgttgattatattttcttaaggtatattttcagtttttgaaaagcagtaataatttgctatgaccctatagcccagttcttaatatctggatctgatactagcatctcttaggtagaaaacacactttctatatgataatatctgtaaagagcacataaatccttggaacactattaggaaaacaaaatcgatttatctcttattgcttttttttggtttttttttttccttttaatcaagacaaatttcaaggaggaagacatgtttctccgcttcgtttttatttaaatgtaccacttgggatttgaagcttccgcacttcttctgtttgtttggatttttttttcatggcttggtcccaaaaaatggaatacaaaatttagagaaagttttgtttgaaattgcagggcgctatgagaattattgcaaatccctgatgtctctttgtctgccctcaattctcctatttttggtaataatgcaggcagtcattttagaaaactttgctttgttcattttactgagcctcttccagaggccatgtgccagaatcaacagcagccaaccacagccaagatcctagggcgtaaactcagacttcatctctcaaatattgctacttgaaatttgcataaacattgaagaaaaagttaaaagagcctgtataactcctcttcatgtattttaggagcctcagacagtcaagacattaaaataccttccgattgagcagtgggtctaagcacagataccacactgcagatagggagaaggatatgaaaaaaatcatgtgagatagacgacagaggcttatttgaagaagctacaaagcaacaagtaatgccagtttaaaacgattacatgttaatgcaacaagtaaaacacattgaaggctgctcagattacactggctgaagtacagacttaattactcatgttagagattcctaaaacaaagggaggcttttaagccagtgatatgtagctggtatgatattgaaaagcattggaaaacctaggtaaatgcctagaggaaattttaaggaagagtccatcaagtctggataccttagccttatccttaaatgaataaatttctgaggcgctggaactggttaaaatcaatggcagcttgttctgttgttggcagttttgatgtataattggggctgataaacctgaataaataaaagagccttgtctggattgagttacagttagtgctaaacatcaagggttcctattgtatttcttaaaagttctttttggagtgattccaagattggtattaagagggtatgccaagggtatatattggcaatttttattttgtttgtatttatcttagagtcatttgggtaggtcacattctctctgcccctactcccaacttctcattagattgtaaggaccatgaggacagagattgtttgttttatttgtgcttagttttcatgcagtgcctagtaggggacaatgctgacagtagtttctcgacaaatattagtggaactgtattaaaattgagtttttgctcacatatattgtttattttacctttagtggatcacttctccttatgccttcagtgctatagttttttaaaagaagtatgttagtctgttttgcattgctctaaaggaatacctgaggctgaataatttataaagaaaaaaggtttatttggctaatagctttgcagattgtacaagaagtttagagccaacatctgcttctggtgagggcccaaaaaactttcgtggctgaaggtgaagagggagcaggtatgtaacatggcaagagaggagggagcaagagagatgtcagtctctttcaaacaaccagctcacatggtagcgagaactcactcattactgtgggtgggcaccaagctattcatgagagatctgcccccataacctgaacacctcccagtaggccccaccttcaacattggggattatgtttcaacgtgagatttggaagggacaaaatagccaaactgtatcaagcacaaagaagatacagagatagtcaatggtggagctagtattcaaacccagatttgtctgatttctgcatccatgctttcaactgcttaactgcattgcttccaatactcagaaaagacgaaatgttttccatatcccaggaacttaaaagtgaaaaagcagagagctagaagaccctgtagtgctgaattgagagtcatgagtgttacaaggatgggtgggggggtggccctgtgaggaccagaaccctccaggggaagctttctgggtgaggcaagaggtgaactgggccttgaaggaatgggtagaatttagatagtaatgaggaaggcagaaatcagtggaagcacagacatgcatggaggaatggaactgagttcaatgacgatctgttcaggaaagagggcataaactgggcagagaatgcagtggaagtggtggggagtaatactgggcacgtaaggtaagctctgatctggaaggccagcatgggagcctagactggttaaagtaagaaatggcttgtccttggaagaaaaagtgtcaaacttggtactgtgtgaaggtactgcacagacctcccaactggttcttaggagagccaaactgaggctaagttctgagaactaagtaagaactgacagccattgtaggttagaaagtagtggggcaacatgttacaagtagtgcttctggaaggttagatgcggttagaataaaatcattgccattttggggagctgggaaaatggatgtcttcagtctagtctaaaaagggatgacttgaataagcttatataagaaagaaaagaaaaacctttttactcactggaccatttcataatcttgacttttttcaaacataaatctgtgtcatttttcttatttaaaacagctgagcagtttactctcctacttagagctgtgatccttatcatgggctcttgtgatctaaccccagcctgcctccctggcctctgtccttgcttaataacctctagccatatgaacctggaataccagtctaattcccacttcaaggcttttacacttgttgtttcctctgcctggggtgctattccctcatatcttcatgacacttgttcatttacattgtagctcaaagcatacctcctcagggaggcctttcctagacactatctgaggtacactcctgcacccccagccttcatgattgctttttatacattactgggttttgtttccaatggaacttatcgcttattactgtcctaaattattttatttattaattttttagccacctttctcttatagaaataaggttcctgaggacagggagtttattctgtatactacggtatccctgacatcagggcttgtgcctgccgatagtagatgctttctaaatatgttctgaatattagatagctagttcccaaatgcactgcactgaaagtgtatgaaaattggaaattggcttctagatttttgtattatattgccaaatgatggagtgatgagattgaaatctactacttctttttgccttttttttttttttttttttggtggagtagaggagggcctgcacaaacagcagatacacacacagtaaataagatttatttcagccagcaagtatttattgacatgaaaattggggttaaatgtgactctttgtgagtgactagtttcttggagtctattaaagcatcagtttaaacatcaattctctatggtatgattaatgtttctttttttactttataagcatgaagctgccttcaattttattgttaaatttaagtgttttacattggaaaaaagtaaattgaattttgaaatgaggtctgtcccggtctcactttcatggcttcaggttatcaaagttttaatttctctttgtatggaagataattatagtattcatttttgctcctgagtaaagccacgagtctcaagattatttttcttttttaaaaattagaattgtcagtttatagttgtatacatttatagggtacaaagtgatgttataatttgctaatacaatgtagaacaattaaaaggtagttagtatatcctttatctcaaatatttaacattttttgaaatttactctcttagcaattttgaaatgtataataccctattattaactatattcaccacactatgcaatatatctcaaacatatacaaaaaaattcttcttgtgtaactgtagctttttgtacccattgatcatcaggcccacagcttccgtaaccaccattttcctctctgcttctatgattttgatggttttcaattctacatataagtgagaacatgctgtatttgtcttcctgtgccttatttcacttagcataatgttctccaattctatccatgttgtctcaaatgacagaatttatatctaaaggtggaatagtattccattttatgtatctaccacagctttttttttttttttttttttttttttgagatggagtctctctctgtcactcaggctggagtgcagtggagcaatctcggctcactgcaacctccgccccccaggttcaagtgattctcctgcctcagcctcctgagtagctgcgattactggcgtgctgtaatttttgtacttttagtagagatggggtttcatcatcttggccaggctggtcttgaactcctgacctcgtgatccacccacctcagccgcccaaagtgctgggattataggcgtgagccactgtgcccggcctatctaccaccttttatttatccattcatctgttgatggacacttccataacttggtatgggtgtacagacatcttttcaataaactgatttaaaatatctggggtaaatacgcagcagtgggattaccagatcatgtggtgattctattttcagttttttgaggaacgtctgcactgtttttcacaatggttgtactaatttacattcccattaacagagtagaagggttccatttctccacatcctgtttattcagacgatatgttatcatctaaatcatctaagacctctatattatatagcttttgagtatttttaaaagtggacactcaagcgttcatatagtcatagtcagtgtgtggttcctcagacctgtggtatcaacatcacctgggaatttgttaggaatgcagattcccaggctccctgcagacttagtcagaaattgtgggggtcgagtctaacactcttttttaaaaagccctccaagtgattccagtgcttactaaagtttgagaaccgtggctcagtaaatgctaaaggttcaaggtagcatgatcccacacatcagccaagtggcattaattattagcctggtaagcccaccttcttttcagtcactgagtttgattggttcactagggctaggctgtaaagttatttgctagattgattgctacatattgactttgggttgtttgtatttctctgaacctgtcactgtaatgatttgtcaggacacttaataggaacaggccgtgatttttgcacccatggcattctgagtcatgggtggctgggtcattatgtactccaggtttcttcaggcactgggcatgccattcatgtacttataaggagggagctgtcgctggtggatcacagggaacctttagggacatttagttcgctctcagcttggtacaggtagggaaattgagcccccatgaagttgtgctttgcttgcagttaggggtacagacaggatttcaggtctcctgagtccctccactgcaccaggattcctgcagggggacagagctacagctttttctgtgcctacaggacattcctttcctactgtgagggttttatttatttattattttatttaaagaaaaaaagtaaatagaaaaaaccccggaagttctcactgaaactaataaaagtgtctaaagagaatgaaaaaatcagtttgagaactttggtatggaggaaataacctgacattaactgttttaattatagttgttgcattgggcttatcagtgtgggaagagggagcatttgagccttacagggaagtgggatatggacaacaagatgaccctcttcctgaatttgcctgtttgggcctgcagcctggtgactctttgtgtgatcccaacagctgtcatagagatgggttggacttttactgagacctgggtcctaggcccagcactgccaccagctagtggcgcgatgccccataaagaggccacttattctctctggcctctactattggtaaatgggtataataatatccaccctgccaatcctgagaaatttcaggtagtgggaagcagtgtatcttggtggttaagggcagagtctctggattcaaattctagctttctaactcactggcatggcagtaggcaggccacttatcctccctgttttctcacctgagaatgggtataatgaaatttacttctaagggttgttgtgaagattgaattagttagctaatttatgtaaagtacttaggatagtgccggtatttagtaagttctatgtgttagcctattattattactattaccatttaaaaatactatttcaaggatgggatgcattttctgtaaacatgttctcaaatgattctactactggatacaatactgggcttttatgcagtaattgttgttggaggagttgttctgacatccagcttgcacctgggctactggtttcgtggccagggatggccaggcctagcgtctctgatcttgcacaatttatgcatagagtggtgtggttagaggaaacttggaggggggaacttctcagttttgctttcaggtatttatacattaactatcataagagatggacatcttaataacttccaagaaagagttcatgagcttcaatttgatatttattgtttgactaggtttctttctgtcttacctttccagttgttagggttcttgatatgtattttggtgatgaaaatttcaactctaaaagctaaacaatcaagatattgtaattatccagcaagtgattagcagatttcgagtagacttcttccattcttggctgaaatcaatgaaaatgtctactattgctgttgtttttgttcttttctctgaaaagtctgtttttgggagggcctgagatggtaaagtgcctttttattgtctcttaaagggaatgggggaatcaacagtttgagaatttttgttttatctgtatgtataaaattgccttctccttttatttcttttgatactctctctgcagtctctattcatgatctactccccatctttttatgggccccttaaagctagagattatgtttattcgtttatttatgtattccatttctccttttttctggatcctaattttgtgcctggtgcatactaggctctcaattttagtttgtcgaattactgttattgctgtttctgattacttcttgaagcggtctgttttaaaacttcacctgaaggctaagtaattcatcagtataatggtgatctattatttatctagcattttcctaaacactcattgatgaatccttataatactcatctgaagtatctaaatcccaagatgatgtgtcatgtcatagatggtatggctttaatttttaattgggagatggagatgtaacagctggagatactgaaacacagagaaataagagcatgattcaagaccacaaacgtggttattgttggaagatagttttgggatgggcttctgtgctagaagccaaaacataaaaaactgattaaaactctaaaaagaaacccagattaggtgggaatgaatgctgatctggattggattacacttctttggtgtctgagggttatgattagtgacttacttctaatgtgcatttgtttttatttttagcattgcagtgtcgagatggctatgaaccctgtgtaaatgaaggaatgtgtgttacctaccacaatggcacaggatactgcaagtaagtttttctcttcatatattttctttttgcgatagaacactggacaagatttgattctactcctctatttttaatgcttctgtggaatgttactggttcttgagctttcctggtacagattttggttgggggtgaggatggaaggatgtggatgccagataattggctaataagaacttcttactatcttactgttatctttctcactatgaaaaagacttttcagtgagtggctagttaatgtatatggggtagaccaggcatggtggctcatgctggtaatcccagcacttcaggaggctgagttgggcgaatcacgaggtcaggagttcaagaccagcctggccaacatagtgaaaccctatctctactaaaaatacaaaaattagccgggtgtggtggcgcatgcctggagtcccagctactcgggaggctgaggcaggagaatgacttgaacccaggaggcggaggttgcagtgagctgagaccacatcattgcactctagcctgggtgacagagcaagactccgtctcaaaaagaaataaaaaaaaataaaaaaatgtatattagattcccttgtgtttttcagattaaggaatactcttagagtctccccttaacatgttacctattatcttgtttttaagtaaaaccaaatagatatcaactttaatattcggcccagtatatgtgaatattatattcatatttttttctagtgtaaaaaatctaattctgaaagtgagacagtgagagaggaagatgtgtgcatatgtgtagattgagggggagcaggggctttgggtgtgtattattatatggggataaaagagtaaggatgaaggaaaatgtaggctagttcttggcttaagagcatttttttttcctttttctccaaccatctactctagccaagacgttttgtttgtttgaggaaggctgtgagataatttcataatagcttttctatgtttcctgcaaataattttttttcttctgcctcaattgaaaatttttaagaggaatatgtatccattctgtttatttcagggaagatgctggagaaataaaatttggtaatatgaaatttctcttcttttccttcatttttgtgaggagtagttcttctttgctttggtggaggtacttgcttagtaagcattttaagtgagtttatccaacacatttttatttcttaccaggaatgtaattacaacttttttccagtgagatctgttctgacaccaggatttagttttttaatgttataaacaagatttttttttcaagtcagaaataattttcttcactaaagtgaaaattaagctgtgatgacagtaaagcttaacaataggttgtttggattggaataaagataacattggaaataaaggttttatgtagcttattatgggctgctcatttagtttttctagctgggggaaaaaaaaatgtggtgcattctcctctaagaatggagatacaactggagataataagggagggaacttaataccttagagtaggccactgaaatcttgtttagtctttttgtggcatttggtgcgttagttgcttgctttattctgttatgcaactcttgtggtagttaaccccattgcattatggtcatttgttgatgtgtttcttttgctagaatgtgaggtcttagtcttatgcattttttgcatagttaatgcctagtacagtgcctggtgtagttattgttcagcaatgtgtttcttaaactaaaaggtgctaagtagataccgtcatgcacatgtttcttatctatttatgttaaataagaagacactggttctctcctttaaaaatttcagtgtggcgattcctcaaggatctagaaccagaaataccatttggcccagcaatcctattactgagtatatacccaaaggattataaatcattctactataaggacacatgcacatgtgtgtttacttcagcactatttacagtaggaaagacttggaaccaacccaaatgcccaacggtgatagactggataaagaaaatgtggcatgtatacacgatggaatagtatgcagccataaaaaagaatgagttaatgtcctttgcagggacatggatgaagctggaagccatcattctcagcaaactaacacaggaacagaaaaccaaacacggcatgttctcactcataagtgggagttgaacaatgagaacacatggacacagggaggggaacatcacacactggagcctgtcagggggtggggggaaaggggagggagagcattaggatgaatacctaatgcacgtggggcttaaaacctggatgacgggttgataggtgcagcaaaccaccatggcacatgtatgcctatgaaacaaacctgcacattctgcacatgtatcccaaaacttaaaagcaaaattaaaaaaaaatttatttatttcacatagcattcagggtggtaataccatacagagaggcaaattggttctatttgaagatcattcaacttggtgacttatatatggagaatttcaaatatgttctaagtgttcgcctatatatttttggtctgacatggggagagaaggtttctaggggagactaatctctgagcacttaccaggagaggacacctaagggtcactgttgggaagaagtccaatagttctttgttggactgttgggctgctagtctcatactctccaaccaaggttggagaccatcctggctaacacggtgaaatcccatctctactaaaaatgcaaaaaattagctgggcgtggtggcacgcacctgtaatcccagttactcgggaggctgaggcaggagaatggcctgaacccaggaggcggagcttgcagtgagccaagattgcaccactgcactccagcctgagcgacagagcgagactgtgtctccaaaaaaaaaaaaaaagaaaatggagctgcctaaattctgtccctggctacttgttaattgttgataggatggaatgcttatggatacagttctgggtatgtccctcagatgtctttcctgttttgagggaaacaaactccttgagagaaagaaaaaatttggtgaggccatccttttgggagaccaagatgaacaacaaaacttgtataaagagagtgattccctacctcagcaaaagtaatattagcatatttaggagtggcagggtcaacataagtggacaaagaaaaagcaagaacaatatcaaggcagccacgtcaatcattctacagtgctttgccagcctccacagaattttaagcaaaattttatgcaaaaataatgtgtacctagcagagctttcagtgtattttcaccaaccttacctttttttctgtggagaaagaagatgatctagcttgttcagtaaatattattttcacaaaatagaaaatagatattaaaacagaagatttataaaaattctatcaggcatgcagggcatgtgattatctttttattcatgcgattgcttagtggattaagaaaagaaagttgaagccaaattccttttacagggccagcgtgggggtgagtggtgagtggtgggatgggaactggtagaaagtgttttaaaatagaaggaatctgactatctgtttagacagcataatgctactgattcagctaaaatataatgattgtttatagaaattataaaaatccttgataagatcacattgacagatgaagataactacttttgaagattagttttgtactcagctcaactgttttttctcagtgttaggagcctaagtaccctatcagtctgtgattagattttgatgccagattaggagaacttgtataatcttgcataaaactcaattattgctgttaaataactactgtcaaatcttaataaagccctctcactacagggagataagatattttattctttcccttgtcctactgggaggtgtaaatatgtaattaaatttgatgtcattaatcactttcaagttgtttgcttcagattttcaaatataaaccattctaaatcccaatttgattaaagatcatggacaactcaagttcactaggattctgggggtaggttaggttatgatttgtataattgacaaaatatgtattttaaggacatttattgtagttatttaaaatctttgtctgctggttcttaacatctgggttgtctatggatgtgtttctgtttctatcacctgctccttctttggaccatgggtatgacttccctttactttacacatgtatggtagttttacattacttactggacattgtgggtgatagattttaaagtttatctcccactaaagaatgttgaattttgtcaagattggcagatcatcttgatcctatggatgctaggttttaggacacgttagggtgggcctacttctgttctgcccttagtccgatgacacaaatcttagtcatgggatagggctcttattcccaagatgtgacccttctaggggttcagtggaaagtgtgaggggcctaccaagccctgaggtgttcattaagcccctctaaggcagaacttgtcctcccagccccaggagccttctgctcagtcttttcagccgtccagctcttactttctcttgggtttctgaatcttatcttgctcatgcatagtcaggaattatttaaggatttgagcagagttgtatgcatactttgaagctacccactctgtggttctgtcttttccaggaatttttctcctcatattctagctgctgtgacagctccagatacctctgactcctcagtatcgcaggacttccgttttctgcttgcacactcttcctcttctgctgcatgaactggggtgtaccttcacgataaaaaaaaaaacaaaaacaaaactgtaaatgtgggtttcatatagtttgcttcgctttttctgaggcttatatcccttctagtttatgcctgctttcagtgattctccagtgcctttgatattttgtccagagcaagagggctagtctgatatgttactctgcaattatttttaatgatgaaaattggaaatataaaggggcctttcagaatttcatacataccacttggtaaatatctaacatagtgtttgtaaaacagcagaaagtcaccgtgagttgtatacgttcctgtagatgggtgcttgcatttgagaatgtccactttttgctaaagtgctgatctaaaaactacactttaaggtaaattattataaatataaagtgttataaaatataactttgtgtcacattttgtctaaaacttgtctgctagctgtaataaacattaaacattaacagctaacaattctccttgccaggattaggcagtcatgttggtggtccagatttcctgaatccatccaagaaaaactagagccattgccttctttgtcttcttggtaaatgtctgtatagtaagtagagagtagagacactcataatcccttagaacttagctttttatggaggatgcattcgcaatgtttctgttgtggtgcttctcccccaaaaaggcgttttcagaagtcatggctgactcagcatttccccctttccttcaccttcttgtgagtgcattcagggaggcacaggggcattgtcagatcaaagaaatagacagggaaaaatatcaactgttaaattactttctctttcttctcagctgaaactggttctgccagcctagttccttcaagtacggtgcctatttagctgaacattgtgtgtatagtttttctggaaaatgatagcagaagcttggccagttttccatagttcatttatctttttaacataaaacaaagaatgctgtttttttggctcattaaatacctctcatagagtaatcttttcttaaaatgtaatatgttcaggttttattaattcaagagttatttattgcatgctatttatgcgtaccacatataatagataactcaagtctgtggtagtagttgcagttaatcaatattgttatcatattatttcacacttctttgggaagtcataaaataattaccagttcattaacttgggcttcttagagaggttcagagtaaagccaagtatgaaaaaaactgactataatgtggccttctgtacaggggccaccagtgaatggcagggctgggaccatggtgaggcaagtaaggcacaggcctctcttgtgaaatttaagagagtgccaaaaaactcactaatcaaaataatgtttgtatgtagttgttcaaaaaatcaaaattaatgcaaaataagttgaaaattatcaaaattttaaataaggagatcagtagtactgattttttcttttgccttatgacctagtatggttcagcctgcactggtgagtggagtaagggtcctggaagatccttgactggtgacatgaagaggacatagttttttgttgttgtttttttttgagacagagtctcgctctgtggcccaggctggagtgcagtggcgctttcttggctcactgcaagctccgcctcccgggttcatgccattctcctgcctcagcctctcaagtagccgggactacaagcgcccgccaccacacccggctaattttttgtatttttagtagagacggggtttcactgtgttagccaggatggtctctatctcctgacctcatgatctgcccgcctcggcctcccaaagtgctgggattacaggcgtgagccaccacgcccagctgaggacataggtttttttatgccagatagacttaagtttgagtcctgattcctattaacaattggatctttggcaagttaaagtctataatgctagctaacattattgcgtattagggtctgttctcaagtagtttacatgtatttactttagtcctcatgtgagagagagactatatggaagctaagagaagttaaataattcactcaagatcccatcactctgtagctaacctgagatatactcgtggaaaatgtactgtcacgttgagtctcagtttgcctgtcaataaaatgggacagaattacctgttttaagttggtagttcaaatggaaccttctgaaaaggaagtgtggaacatttgaaagtatacaaaaaggggacttttcagatcaggaatatgattaaaacactgctttatgtaatttctaaatttaaagacagtagcattaggtaggcctgagtacctcatatcattctagaacactaaatctgcatatagttacatgagtgtacatgggccaggtttggtgaatactgcatttctgagaaatggcctttaacatgaaagctcaatgtaataactgtggatgaaatagaagaagagggcagtgaaggtggggatagaggatattgtctattaaagtgtgcttcagtagagagaactaatttgaaacttctcctttctttttactaatggaacaggagcaagtccagacagatttatgcagttgtgaaattgagacaggttaaattcagtgatttttgataaatgttgttgccagcacaaaagtcacaagttgttgaatatggcaccttacatttgcatagtgagttacagatgcataggagtatgtcctgtgaggcttttccttgtattaggacttgagatctggaccctttaacagtacctttcctaagtgattcttattaatacttatgtcctattaaaatcctttatcaaatatgatgtttccctaaggggtcttttgtaaaggaagtcttggttactagcatctccatctgtggcccaggcttgagtgcagtagagcaatcatggatcactgcagcctccacctcctaggctcaagccatccatcctcctgcctcagtctcccatttttaaaactttttatagagacacggtctcacatgttgctcaggctggtctcgaattcctgggctcaagtgatcctcccacttctgcctcccaaagggctggaattacaggcctgaaccactgtgcctggccagttagtagcttcttaacacatagcaacataatttccatactattttcaactaatttttattctttcagttgggacctttatatatttcagtgttcagtgaagaagtaggagaatctggttcttaggctctgcctatatccttttacctgtcttgggtaactgccaagaaattaaatcaacaaattttggcctgcagtctggcattaatagatgtgaatttagctaggtttctttcaacacagtctccaggtcaatcgtaatcttatgtgaagtttcttattcaggcatgtctcgttagcaccattaatttcacacaggaattctttttttctccctttttttgtgactaagcaaaatgagaaatatttctctttcaggatatggagaggcttaattaaattctttaattttgtctacatctgcccttatgaatgatagcaaaggaatgggggatatcagaatatgagaaaaagtaatcatctaaaaatttccaagcactttaaaatttattaagctagcataaatatgtgggtgtgatagaggttttcattaagcctcctctcaacatacagtagttaggaatgaagtttagtgtctctccgtcctcctgtcatatgtgtgtatgcacacgtgtgcacatgcgactgtgttatgcattttgttttcatatttcttttagttgggttttaccttacaacccaacgtaaggtaaattaaaatttctattggatttccgcacattttctagatcctatttattcactgtcagtgaccttcactagcacttagtcctctgagtccaaaaatgtattgccaattcttagactccatcagccttctcctatgaaaaagtaatgcagttaatttctgctcaaaatgctcttctcctaaacagtcttctacttgatctttatgaaaagagttttatgaaagaaaagtgaaaataaagactaagaaagacattatttaagtgatgggtgatattattcagtgaacacattcaactatagcattctatccagttttttgccttcacgtaaatatgaggagaaaggtaggtgttaataagaaaataatctgattaggatttatgtagaatggtagcatttagggtattaaatctgtatagattcaggtcattttcctgcagtcactgtctataatcctgtgtgctgaacactgaaagttagatggactctgaagcgctatagaatcctcacttttcaaacaaaagtttaatttttatcacactagtatttattgagcaggctactataactgatcactgtactgggtattgtgaatagacagaaaagcccaagaggcctgtgttacctgacttctttattcacaagtatacgtacccagagactgtctgacagtgaatgcagtttctcctgcataagacatggtggcagtcttctgaagtcttgctggggagatgaagcatacagagatgtgtaaaataaaacagtttgtaatatcccagtgtaggggcacagataataactatggacactcagacaaaggaacaagtactgtgggacaaaagagtaaaatcagaggacttttggtgcactgcttagatcctaaatctttgaatattagtggtgccttagaagatggataggtaggagaagggtgagaggaagggagctgaggagactagaagggactgttatttcctggaataatcattaccaatttcttcatcacgttttcttaatgacacggtttcaaacgttttcttcatcttgattgctgtcttctgtgtatatgctggtttgtgtgaggttttactaaaccagtatgtggattaatctagtttcacagtgacaggtaagtgatttagaaaatcattcctttagcacatgttaacttgaacgtttggaggtagaatgcctagagtgagggtgaaggagaggacctggggacaggaagagagggcagctgggagcaattatgctccttccctcagacctttttggccttgactcttgattcttgtacttctaccagacagagaggcggtaggcttgtggccatgttttgcgaggaaaatcagaatctaagaatctctaaggcaagagcaagaatggattgggataggggaagtgataggaaaacagaggcactaagaagagggttggttttcatgtactgcatagttcattcccttagttgagaaatcaggtatctcaacctcagatatcttctgtccagcatatcgctggccagatctgattcatatgagggatccagagtaaggaagcatctgttagccaagtctttggttaccccaaattagctcaggtcctttactgcttgtttcctctgattatatagtacatatccaaaccctcaattttccagaataaactaggtctgcctattctgtgtggaaaacatttgatggtggttaagattctcttgcctagacgatggtagtgccttagtcgtttaactgcctgtcactttaagattttgaaatactgattcttgttgtgtaagccagacacatcttgagaatattttacggggcaacttgccctttctgaaacctcagtcatcctgaaaagtaactctgtacctccttgactttaatttttctgtcttaattctatttgtatacaatgtttgtggtgtctgattctctgtctcgtattgctgaaactcatggccttgaatttctgggtcactcttaaaaaatagacataacttgattactaatgaaaaagtgactcattttcttccaggcaaaggctgacactgactgtcacagtttgtgacagaagcagactctctaattaggagacatcacctattcttttctaaattttataagaattgatgatagcatcatgagatgggaagtgagtaagataagcgtttatgcttgtagagaggatgcataaaaatgaaatctggataaagttctatctgaatttacctttttaagtggttgattccctgtgagcttaaatttagtgcttctcttcccagaccgttgtcttacatacacacttcagtcagttttagccttgtataactaatcagcaggtcagattccatcgaggctgaaatacctaccaccattctatgctcaagaaaacaggctctcatgttggccagttgtttgggatagaagatggttagacctttctatcctttttaaacacaagattctttttcattccccttatcttgtttaaatatattgttccttctctttggttgttctttgctttcttatgcatctgtgaggggctagctgaaagtgtgagttgtggaacaattcatttacataagtgtatattgaattatctgtgcacctagagggtgatgggcactgtgagggatattaaaaaagagacacagtacagttcttaccctaggatcccctgcttggagtgggacagtggtcaagacatatacaaccacaaacacccaaacattaacatcaacaagcatcattacatccttgggtggtattgccaagggacttcaaaggccaagattatagagtcatcacacttaggaggtcaaagggactttggaaagcacctttgtcactcattttgttttataagtgaggaggctgaggtgtaatacagctaagcgaattagcctttattacataactcattaggatgtagactgggactaagagctgtttctccagatcccattaggcaatctaaagattctgcactatttctttttcatttttggtatccaaataggtacagttgtttttgatctaggaaaatccttttagactaaacagtaagctttttaaattactctgcttttagatattttttggacttcagaactttgaaggtggtcatccaccaacattggggaatggaaagaaggctccaacacttttctttctagagatcttctttaattttcaatggcagtcactacagaatctagcagttcatgctattgaggccactttgtaggattttttttttttttttagtcagggctccaggtccctggtggtttatgtagtcagtcttatcaacaaccgatgaaagaccaataaaagtgcaagagggaatgaggactgtgtgtgtgtatgtctgcacatgcacacatgcctctctgtgtgtgttggttaacttcatatttggtaggtgggagggaaggtgattaaaaaataatctactttgcatggagttggcccaatttgactgatataggggtgagtgggggttaagaagtagtctatatatcaggaatcttaattagttttgaaaatcctttaggtaaatagctcaacccagttgttcccaaacttcaagtgtatttatagggtctttttaaggggtaaagattccacagagcccttcattttgaccttttgcttctgcactgaatagtcgaatgccttctatatgccagtcattgtgttaggcactgggagtatgagaattaataattttagtctgttgacagataatcataataagggctaatgagtaacacaggctcagggttataagaacagagggggtgtcaaggctgtttttcacaggaaataacatttaagttgatacaatgaaattttagggcttagccatgagaaggtggggaaaagcattttgggctgactgaacagcgtgtacagaggtctggaagtgagaagtagtgtactatagcattttctaggagctgaaaggcatttagcaagagtatagcgcataaaggagagagcttgagatgaaacaatttctcagtgtgttgtttgaatacaatgtatactgtcaaaatctaagaattcaagaatcatttaatatatctttatgttttactagtcataaaagcatatacatatatttaaatatggacaagatactgtttagtagtttagaaagtgatttatgaggattgcaatcccttgcaataactccacagcccataccttgggaacaactgagctaactcattcagttttgtccattacatcgaagggtgttttttgtaaactcatatgtctagaatgtgtttgccatgttttaatcacaagtagatattttctcagagtccagtgcagtgaagtatggtaagatcctgattgtgttctggaacacagaggaaagaccaccttctgttatagcaacaacacaagtcttttaacactgtgtgccccttcccaatctttcaagtgatgattgaagagactaggtgctcagctcagcctttgagttctgataaatgagcccagactgtaaactggaagataaggatgtttgtaaagttcttgtataaataaagcatggtttctcattgcagtggttactgatttcatagtctgagtgaagatgaatgatgctgtgaatcaacagctttaaagtccgtaccacttcagcttctttttggtttaggtttcttaaaatcagtgtgtatttaatgctttattcagatgagggggtgaaaaacctaacacatgtaaactaagtgaggtggggtttcagagataattcccagcctcacaattcctcatgaagttcttttcctgtgggaaacttttaatttggaagcatgcaacctaatgtgggaaccaagattaacattttctgaaatacttctacaagaaaagcagaaatggtctgtccaggaagctgaatttacatagtagaaaaatgagctgccctgcagtatttggtagtctttgtgtattggttgtgataaaagtgtgtatgtgtgtgtgtacgtgtgtgagagtgagagattgtatacttgtctttgtttccttcacatacaactagtaaggccctagaaaaactacactagaaagtgtgttttaccacaagcgtcccagttctggacaccaatctatacacaaatacttttttttaaagttctttttgtttttccttcttgctgagtaagctatagtatttccttttttttctttctttttatttgagagaagggggggttgagagtagagtgggaatggcaagaagtagtatgacagagcttcttctctttttttcccctctttaccaggaagttaactagaagtcttcatgcatgtttttaaaacaaagttggtaattagcataacctagttagttacctttacacagagtgacagaattaaaaagttgacaagcccatcagacctcagccaggaggtactgaaaggagggagaccagtgagtctagaccaataggtgggttaggcctcctgaatgccagcctagaagtttagacttgattctataggctctagggtacctacaagtttgtagtcgcagccttgggaattgaatgttacataggaactttcactggttccagctagccttggctgttagcaattatttttatctactttaacaggggggacagagtaggggggcaggaaactaagctggcattatggtcacaggaaagaacagactgatttggagcctttcaaactgcagacctttgttactgaccgatgcttaatttggtttctgggttttgttagttttttcccctgcccttacctcatttaccttaacgacagctcccccctctagagctcagctagggcaggctgccactgtggattggggggccaagaggcccagtgcaagaagaaagtgggttgaaagcagagttctgtttaaagaattttctgctggaaactagcccagagggagtaaagaggagctttaatgaggagcagctgcagtgccgacgcaacccacatgagacttttttttccccttcgttccacattctgtatagtttttttaaaaatcatgactttgaaatagctgttttgtaaagcatgcctctctttttcttcttgtatgtggtgggattttgctttgttgttgttgttgttgtttcttgaatggccaaatcctcgttttaaaaaaaaaaaaaaaaaaaaaaaaagctaaagacagagctgcagcaaagccctggatgcaatttggcctcaccctgctgatacagaacattcggtggagaaaacaaggggagagaacactggcttttatttggaaaaggggcttatttcctgctcagacttcagtcatcttggagctgacacaagctgctacactgttttaagcttttctgtagacgagtggctattcacttaggaaacgtgaaagaacaaatttttctgtcctgtattactagagagactgatcctgaactgcagccattgccagatagattggaattgctattcagatcccagcttcgttgaaatctgtaaagtggctacatgtaaactaatccaggctgctagtgagatgtgagggttggggtctggttttcatctgcttaagtgagaggaaactgtaggggtatccttcaaatggaatgttttctagttccattaggaggaatcccttgtttttctctgttttcttccttcctttgcttttctacatccaaccccatgcgtatgtttgaacagtaacaatggaaatgtggacctctcaatgtcagaaatgacacttttttttttttgagatggggttctcaccatgttgcccgtattgcctaggcaggtctcgaacttctgctctagcaatctgctcgccttggcctcccacagtgctgggattacaggtgtgagccactgtgcccagctgagacttttaaagaaaaagtcataaatatatctttatggacctggtaagtattcagattagtttatagagtttaaaatggaaaaatgctccccaaacctttctctgtattcacaacctcatctgcgaagtatgttctttcagagttccaatgctagagaagagagagtaagtagaagtcactgagagacattgaagagacagttatgaaaataattaataaactccctacaggagggaaacattcatatagttttgcggatgaaaggcatctgttagatttttgtggttattttttagaatatacacctttagttcaagtggtagactattttccaaaatgtgtgctgggtagcttaatggaattatagatacgtaagggatgttgggtgtttagccatgttttcactctctaaccaaattcaactttagccatctcaagaagacagctatttaagcccttgttttcaagcagagaaccttactttccaccaagactaacagagtatattttctccttataccacagttgaacagggatttgcaagttgaaagatctcctgccttaggaaacaagggtctgttatttctgactgtcttagctattactcccctttcttcccatgtccataatgctgcttagcttcctggggtgtgaaggataattctatacctcaggatgactattaggttgatttggcctgttattctaccagacagatcacagagtagagatggattttgtggaacatttggattgagagactgactttatccatcacatgaaatttagcctgctttggaaccagctgcttagtggggtttatgtactcaggtattcagggaacctacaccaagggttcaagacagggtcttccccacaaaaactatctagatgggagtttgagaaaggtacagcaaagacataacagtggcttaaataaagaagaaccataccagcggagacaatgtagtgcatgacatggcactacatctgctgttggaaggatcagagacaggtgggatgatttgtagaaggcttactataggacaggtttacagcagatttttgaaaaaagggtggaagaaaggaacctaagttggagatataccagaagggaagcatgatgtttctcactggaaattaaaaagatttcaatataggggacagtaaacaagattgtggaaataatatggagtgttcgagttatggattactaaagagtaagatggttagatgattggaatgggacagacaagcagatcagagattgtaaagaacttggatttgaaaggcttggtattaatactgttgctagtttctgagcagaagaatgacatgaaaattatgcttaggaaagattattcttttagtcatatgcttaggttcagcaaggaatttccagactgtccttagggagaggagaggtatggataggatgctggtccatttaggatgttagagctgattgaataagtgctagtcttggggcaagacttagtcatacactttcagttaagtactgtttcattgcaaggtctaggtgaagatagggatatatttgtaaaactggggaaattgctagattcacagataaccaactttgggtagatcagttagctttggtgtccttctcagtgctataggggttcagaccatttggtttctgagatcactgctgaaattctgtgattgtatgagtataatgtaaaagttgtctcaatcaaggaaacttggagtaaagactcaatatgatggatttaaaaggaatgaatgatagttccaattattgggttcaaaaaacatgtgctacaagtataagatgagaaaaatagggtacactagtagttcatgtgaaataaggctctgaatattttagctgagtgtgtattccatagcacatagtagtattttgtggcttctaaaaaagtacacatatccattgggtatgagtcggagcgttattctttcttgaactgcgctctcacgatgcctcctcagtttaagaacttactctgaaatagtaaaagcatagtgtccagatcaggaggtcatggttcagctctgtgctgcactggtaagaacatgtgttaagcctttttccattttgagcctcactttttaaagaggtttttgatgaactggagtcatccagtgatggggaggcaggatagcctagtgttgaagcacacgcactctagagtctacttgggtttgaatcctgcctcttccatctactagctgtgaattttttttttttttgagagggagtctcgctctgttgcccaggctggagtgcagtggcgcgatcttggctcactgcaacctccaacttctgggttcatgccattctcctgcctcagcctcctgagtagctgggactacaggcgcccgccaccacgcctggctaattttttatatttttagtagagacagggtttcactgtgttagccaggatggtctcgatctcctgacctggtgatctgcctgcctcggcctcccaaagtgctgagattactggtgtgagccaccgcgcctggcctagctgtaaaatcttaatctttctaagcttcgagttcctcatatataaaatggagattataatatagcactggagcgagtaatacaagagacaatagctatcaaatgcttagcaaatatacaatacatagttaagtacttagaaaatatgttttcagttacttcgggtatatacctgggaagggaggcagaaaattttggtcattctgattattattactactgttaagcatagaagcaccactaaaaaggtgaagaagcctggaaataaccctatactgaggaatatgccaaaccattgaatcctggaaaaaagaaaacaaaaggcccacataactatcttcagattcttgaagggctacgtgtaagagaagcagaaggcttgttcttttttgttctagagggtagagataacctggaaattgtagagagacaaagtttgttcttttcaaagttaagacataatttatgtatcataaaatttacccttttaaagtgtttaatttagtagacttcagtatttccagagttatgagaccaccaccattatctaatttcgaaacatttttatcaccctgaaagaaattctctactgcttagtagtcactgtctatttccctttctttacagctcctggcaacactaatctactttctatctctacggatttgcatattctggacatttcatataaatggaattatataatatgtggccttttgtgtgtggcttctttcacttagcatgttttcaaggttcatccatgttgtagcatgtatcagaatgtcattccttttcatggccacatatttcatttatggatataccacattttatttatctgttcatccgcttataggcatttgggttgtttctactttttagctattatgaataatgctgctatgaacatttttattatctgggcatatgttttcagttatctcgggtatatacctaggaagggaggcagaatttgaagaattaagaaagagctttctcacagtggaatccacccacattgaagactgttcttttgttgaagtagtcagccagtaatttcacttaacaaatgcatagtgtttactatgtgctggatagtgttctaagtgctttacccttatttaaaaatcctatgaagtaggcactgttattacatctcttttacgacagggaagtttagtaccttgcccaagattacacattgagtaaatggtggagttgggattgaaatccaggtggtctggttccagagtctgtactcttaagagcagaacaataataactccaagcatttattaaattctcaagatttatccggcaccatgctacatgcttgtattcaagcagaggctggtgatcatcttttagaaatattttagaaatgattacttaattggatagaaattaaatttcttgaatctgaaggttctgttattccaaggatggctggaaatgggggaaaagccagcaacaagatgatgtctggcctgaggcttttaagatgatcagaatttgtatcaaaaaggaaactgtgaacacgaatgataagtattataggaattcagttaacaagtcttgtcagaatgtggtaataaattatatacaacttaaagagatgaagttactttaaattgtgtgtggaagccttagaaaaattgaataattaaagtttcttgggaagatgatctccttttacaaatgtttagtttcaaatagtggcagcacatattaggatagagagatgacttctagaaaactgaacatatgggactggaacagtgtattttggagtcagttacaggaaggaagttgtttaaaaccaagtgaacaacaacagtaacaaatgcatttgagagaaagagcagtgcagtccagacttaaacattagggtggccataatagatggggaagaaggagaaatcagcaatccagactaagacttcactgggttttgagttagacagagggaggcatagaagccaaggtaaaatgattaaaacggtacatggagtggttagcaattctccctataggagagagaatttccttatgaagtttcagatgagaccactgaacttgactagaggaaagtcattgtttttagaaaacagtttctaaacaataattagaattaaagttttgttgcagagggataagtaagaagtagatggaaaagaaagaggaatatctgaaattaggctacagtcatagaaggttagctgtgaaacaataatttggaaagggaaatgggacctcatgaaagtgtgggttaaaagagacttgtatatcttctaaggtaaaagtaaagaactaagctgatgtccagccctctaaaacattttaaatagaaatcaaactttattaatacagtaggtctagtttcacgtaaagcaaatatatggttctgtacacgggctttaggagagtaagtctgttgtacctcatatgtaagtattatcccatttagaggaaaaccctaagtctttctttacagtggcttaaaggccccaattgatccacatcccagttacagctctcatctattttctgctgctccagatattcttgctgtttctcaaacacgctagggctgctctctgtgttatggcctttgcatttgctgttccctttctcatgaatgtgttttcctaagatacctgcatgattactctcaccttatttaggtctcaactcaagtattgtcagtgaaggtcttctctgattttcctattctaaactgagatacttctctttgctcaccccacaccctcatccccagctccattccttcctgtttaattttttttcacagcacttaactccatctattgtgcatcttttacttagtaattttgttttcgtcttccgctattagaatgtaaactccaagagtgtaagaatttttctagcactggaaaaatgcctggcacataataggcatttactaattgttgtgtgaatgaacgattataagtttaatattctttgtggaaactaataaggttgatttcctatcagaaaccgatcattattaataagcatattggatggtatttatagaattagccttcatatgttctctactcagaagttggcaaactttttctgtaaagtgccagagagtaattatttttgcaggctttgtggtctcattacagctacttgactctgttgttgtagtggaaaatcagccatagacaatctataaatgaatgagcatggctgtgttccagtaagactatttatggacactgaaatttgaattgtatataattttgaaatgtcagaaaatatccttcttttgttctttttttctaatcatttaaaaatgtaaaaaactattcacaggccaaacaaaaacaggcagtggtccaaattagacttgcaaactgtactttgtcaatctctggttttactgatttcttaaatatatcttaggttaaaacttatttttccatacttgatagggagcaacaatgtgaattaaactgtagaaacaaataattcagaaatacatctgtttagctttagaaacttccattttgcttcatttttgttttcctgggaaccttatatttccattatatgtttatgatgctaccatttaaatgactttgcattctcttagcatatgccacatgatagtgttagggtggtgtaatagttcaggagcaaagctgagcaaagcccacccacgtttaaaaatttgccattatttagaaggtgcataattcccatatgggagaatgaagagtcatctaataatgcccagagggctgcactgtgagtgagaattgtgttgcagtttttaacattcataacacatttcttgaataagctgcaaatgcttttaataatatatctcagagttaattttagctatgctacattggcactttttgctcctccacttcaaaaaaccaacacaagaaactattctcaaatcaagctgtgatttggatggggcattgtattttcctcaataagcacaaagaagagagaaaagatgttttcacttggcaaaacttttttttttgagatggaatctcactctgttgcccaggctggagtgtagtggcacaatctcgtcggctcactgcaacctccgcctcccgggttcaagcaattctcatgcctcagcctcccgagtagctgggattacaagcgtgcaccaccaccctggctaatttttgtatttttagtagagccagggtttcaccttgttggccgggctattctcaaactcctgacctcagatggtcctcacacctcagcctcccaaagtgctggaattacaggtgtgagccactgtgcccagcccacttgcaaaactttttaacatttataaggttttttacatacttgattttgttcagttcttagaataatctcatgatgtaggtgaccttattaactatttacaatgtgagaaaatggatagtcaatgaagataagtaacttgtccaaggtcacagcaccagaactccaaaccagaccttctgaccttcttgatacagactcctcacagtcacctgcatgccatctttggtttcagtgctatgaactttcttcactgcctgttggtctgtagctacacctactcatgaagatgcccagagccttagccgctccttgctctgccatgcttatcttatgcagctctgggaggggtgaagaggctgtggccagttacctcactaccactatagctattcaccaccctgttttctcctttagccattttagctactacacaattcttctgggcattttctgtcttagttccctagtatctggccttccctcttttctcagtaactgtgacccctgctagctagccttgccaaccaatggttaatgaaaggtcttggatatgactgtcaaagacaaaagcactcatgaccccaatgtttcaggtcacaatgattaggaaaatcaggacaacaaggcttgggcacagaaaagctggtttttgagagggggatttagagtttggtttaaatgtgtaatctttgaggtaatggtggaacagcctactagattcagttttctagtccctgaaaactaaaacgaggaataagttgaatcacatatttggggcaccagccaaatatatagcagcatttatagttagaatcaaagtgtttgtgtttcttaatttaaatgcttctcagagattccatttaaacaacttcattatgaaaatggagacttaccatgcctttttgatattgttcagagaaaattgtcataaataatacacacagtttgaaatggttgtacatcttatgaatcaaggggtggcatgtaaaaaggttcctcagtgcctcaatgtggaaaatatcatagaatgttattcttcaattgattccttccttgactttggtgtttatatggtatcttagatattttatgttattttaattatattttgtgtctttttatttggttaaaaatgcctacttaaatattaacagatttttaaatatccctttgaactcttccccattcctgtacctcctttccctttttccgttgtaatgtcagccacctgaacataacccagaaaactaggtatcatccaattgatgtttcagtggaaataagagaaagaagcacttactatttctcaatgcttaattgaggaaaagcacatgatatcttacatattttaaattggaggggataatagggtcaagttcatgcattatattgtggacatcttaatcctatcaaatggcttagtcaaaatgagaaagttaatgaatttaagcagacaagtacgaacagtgctctaaaaaaggtgctgttacaccatcccaacctgtacacacatgaaaaaaagctggggtgcattttgcgtttgaataagggtcatgttgactggccatggcagaccctgctagaccatacagctgatactctgtcacctgccaggactcaaaaggacatgggagtatgtggttaagttctctaaggactctttcttctaaagggaagcagttttataggtggtccttgtaggtctgttgattcacaatctcgtgctttcttgattggactgtattgttttactgtaattttttggacttacaagaagtcaggtgttttcatggactcttctcttttccatacagatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcgacatctcatccatgctttgtgtctcgaccttgcctgaatggcggcacatgccatatgctcagccgggatacctatgagtgcacctgtcaagtcgggtttacaggtaactaatgagaccaaagccagtgctttcctaccttcagcagatacctttatttagcatcttttagatcatggtgtctggctcttaaatgtcccccagctctggtgcacatttaacattatgataaggaactgggatgttccagacaactatccctaacttccttttaagagtttcagggggcagagaaagagaaagaaaaaggaccaaatactttgactgcttaaagtatatatgtcagggccaggtgcggtggcgcacgcttgcaatcccagcattttggcaggccaaggcaggaggatcacttgaggctagaggtttgagaccagcctgggaaacatagcaagaccccatctctacaaaaaaacaagaataaaaataaaacaaaattagtcatgtgtggtggtgtgcacctgtagtcctaactacttgggaggctgaagtggaagaattgcttgagcccaggagtttgaggctgcagtgagctatgatcgcaccactgcactctagcctgggtgacagagtgagaccctgtctcaaaaaaaaaaatatgtacaccaggatggggaatcagagtttacttcactaaaagaaataagtacactgtcaccagaggaaaagttgctgatgttattgactatttgcttttagaaatctccctccctagacattcagggcactggcttttctggttttctgaaccctgttccttttgcttcttcattaccttgttcttatccattaaatgtttgtgctccctggagcactgttttgcgccctcttttgagccacatcacagctctccctagggaatttcactgtctgtattcgcctccactgccactgtcttcattagcttgctgatgaatctcaccatcattcccttagctccacccaaccctgacattcaggctcatgtttctagttatcctttgtatgttctccttggagatattctacaggtactttcagctcaccttgttgacagaaatacgtagcaaccatgtacatcccaaatacccacgctagaaactccctgtcccttgttctgacctcatttcaactcagtcacccaagccaacctctgagttgcctttcacctgtctattcctcccatttcctctgctaccctgtagttgaaggccatgttatctctcacctgggcttctgaagtagtttctgaatacgttttcttgcctttattctctccccatctcattcacccatgatattactacatctttgattataaatgcaaatattctaacaatctcacctgcttacaatgtctaatattttttcatcatccgcagaataaactgcaaactcttttacatgacttccatagctctctacagcctagactttacatctttttatagcctggcctccccacaagcatctaggcctagtcacaccaaattctccttatttcctgaaaatgttgtacttattattgcttccatacagttacacacccttttgcctggaatgcccttttctacaactggtgattgtccaatgttatttaaaactgtgtctcagtgaccctttcatgattcctttaggcaaatggtctctaagttttattagttttatgtatcacattttattgtaattttttttacacatatctcacctgaatagattgtgggtttttctaggtgggtctgagctttattcaaaagtgtttattaaattagatgagaaaaggaggaacattcttcattttttctcctgctttaagcactaaaccaagagttctataaatgcaataagcaaaaaagtgaaaaatgtactcagaagactatactggatcagttagtgtagaatactgttatattaatttttcattgtattagggttctctagagggatggaactaatggaatatatatgtatgtatatatattccaacccaaagtgtcttggtggcaatcttaatatatatatattggcaatctttatatatatataaaggagagtttgttaagtattaattcacatgatcacaaggtcccacaataggctgtctgcaggctgaggagcaaggagagccagtctgagttccaaaaccgaagaacttggggttcgatatttgagggcaggaaacatccagcacgggaaaaagatgtaggctgggaggctaggccagtctcgctttttcatgtttttctgcctgctttatatttgctgacagatgatcaaatggtgtccatccagattaagggtggatctgccttccccagcccactgactcaaatgttaatctcctttggcaacaccttcacagacacacccaagatcaatattttgtatccttcaattcaatcaagttgacacactcagttttaaccaccacaaatctaccccttgtcaacttgaacccgtacacatctcctgagatcacacataatcttcaaataaagacaataattaggtcataattacacctgatgtagtacaactattcttcatacatccggaaacacactagtccccaactgaaacactcttacataaagttaacgatacttaaatgctgatgtgaagtcaataaatcttatgtcacatgataaaggagaaaggaaataaaatgaagatattttcttagtacaagtgtgtgcaagcacagacatgtttttaataaaagaaggaggaaatactgaggacaattacagtcctcatttctgcagctggtcacatggtagtagctggtattgatgactaccttcttctacccattttgtattccttttgccttcagcaaacacctcagcaggttgtgtttttttttttcctgatggagaggcccaaaccatttgtagtcccgcctggattgggctgttgtagttgcccattgaccttaatcacagggcatggtaatactaagagacgccctaatggatctcctgtattccatgaatactctttcttacctccgttctggagtagtagactgatttcatcttgatagcctgggtcttgatagccttgatgtcccagccaacactgtaacgcctttcttagcctgtttacttaaaggtaggaacccaaagtgtcctggtggcaatcttaactaccagtttaatggaattgttgttgtgtcttctgatggcagcgttcctccctctggaactaagacctctaggccagcagaacttaatgttgcgggaacaggaagcaaacattttgctagtggatcactaggggtgatggtgagtggtaccacttccatttccaccccttgattcctggacctgtgaatcctggctatgggagaaacagtaccacatattggacgctgattcagagcatacacagccttcttgagaactttgccccaaccctgcaaagtattctcacctagttggcattgtaattgtgactgcaaaaggccattccaccgttctgcttcaggatgttggggaacatggtaagaccagtgaattccatgagcatgagcccactgctgcacttctttagccataaagtgaatgccttggtcagaggcaatgctgtgtggaataccatgacagtggataaggcattccatgagtccgcggatggtagtcttggcagaaccattgcatgcaggataggcaaacccatatccagagtaagtgtttattccagtaaggacaaacatctgcccttttcacaatggaagaagtccaacataatcaacctgccaccaagtagctggctgatcaccctgaggaatagtgccatatcaaaggcgcagtgttggtttctgctgctggcaaattgggcactctgcggtggcagtagccaggtcagctttccaccggcccatcttgttttctgcactgggaaggtggggcatgagcacaaatgttaggacctgaaaggtggtgaactctgcctgggcagggcaaagccagaggaaactctggtggaggtccgtagcagtcctgatgtgcaaatcggtcatccaacctgggtgtaggggcgaaagactaattgaaccatctagtagctggttccctccaaagtttccctcgggatagctggcactctcgcaaaaaccccactcttggtaccaatttactgtattagtccattttcacgctgctgataaagatatccccgagaccgggaagaaaagaggtttaattggacttacagttccatatggctggggaggcctcagaattatggtgggaggcaaaaggcacttctttcatggtggtggcaagagaaaattaggaagaagcaaaagcagaacccctgagaaacccatcagatctcatgagacttattcactctcatgagaatagcacaggaaagactggcccccatgatacagttaccccactgggtccctcccacaacacatgggaattctgggagatacaattcaagttgagatttgggtggggacactaccaaaccatatcattcatcaaaaggtgttggtggggtagagggtagttaggatgatccatgatctccatcatgatgatgatggtattgatgatgtaagtcactgaaaatatttggtgttataagaataatttcttcctgattgtcagttttgagttgttttgctattaggaggcaaagtaggggggcatatacccacttaaaatattttaattctggctagtggaaatgacagtaatgccttcttcataattaaaatgtcactctgaaatggtcccaaattaaaacttcttcctttgttgttaagaaggatctcttcttggtgtgttctgcaagattctgatcaccttttttttttttttttttttttttttttttgagatggagtattgctttgtcatccaggctggagtgcagggtgcaatctcggttcactgcaagctccacctcccgggttcacgccattcttctgcctcagcctcctgagtagctgggactacaggcacctaccgccatgcccggctaatttttgtatttttagtagagatgggctttcaccttgttagccagaatggtctggatcgcctgacctcatgatccacccgcctcggcctcccaaagtgctgggattacaggtgtgagccaccacacccggccgattctgatcatcttttatacatatgctatttttgtctatcactttaggaatcatcacagatcaaggtcatccttttggtttttgtgatagcgctatacctcagtcagcttactagctcatctccactcagagatgaagaagcataggcagcaagttagtgcctatacataatatatatggaaaccaaattcagggttgattctttctttctttctcccttcctttctttctttctttctctttctttctttctttctttctttctttctttctttctttctttctctctctttctctcttcctctctctttccctctctctttctgtctttcttctcactctgttgcttagtacagtggcgcagtctcggctcactgcaacctccacctcttgggttcgagtgattcttgtgcctcagcctcccaggtagctgggattacaggcatgcgctatgaagcccggctaatttttgtatttttagaaaagatggcgtttcaccgtgttggccaggctggtctcaaactcctaaccacaagtgatctgcccacctcagcctcccaaagtgctgggattacaggcatcagccaccacttccggcccggggatctttctgtttcagttgtgggcatcactctgaaaatcacacttgctagaagtgagcatttatatctcttctccactgtaaataagtgcctcttagtgacatgagtggaaagacaagaagaattgcagttccttcattttctgtcttagctccctgagatgtatatgctgtgcctaaatttgtgttatagttttctcctttgatttgacattccttgataggcagagagcacttttctgtgctcatatgtcacatctcgcatctttttcccttatagaaaaactcttgtgtctcccatttacctttctatgaggtcagagatttagatactttcctagacaatcaactggagtattaacaaattcaaggagttctcgccatcccattactgggtatatacccaaagaattataaatcgtgctgctataaagacacatgcacacgtatgtttattgcggcactattcacaatagcaaagacttggaaccaacccaaatgtccatcaatgatagactggattaagaaaatgtggcacatatacaccatggaatactattcagccataaaaaaggatgagttcatgtcctttgtagggacatggatgaagctggaaaccatcattctcagcaaactattgcaaggacaaaaaactaaacaccgcatgttctcactcataggtgggaattgaacaatgagaacacttggacacaggaaggggaacatcacaaaccggggcctgtcgtggggtggtgggacgggggagggatagcattaggagatgtacctaatgtaaatgacgagttaatgggtgcagcacaccaacatggcacatatatacatatgtaacaaacctgcatgttgtgcacgtgtaccctagaacttaaagtataataataataataataaaaattcaaggagttcttatctctgtagtttaaataataagcaacttagactaatgacaacaaaaagccagccatgtgaataccaaatttactagttctgtgaggatatttttttctctttctctttctgcctcaaagaatctgctttgcttcccctggcatcatgatttagttttcaacccgtcagagtcttcctgctagtgctggtactttcctacttgagaaagtccacggaataccttcgagacctctgtcctcctgatggcttctatttcatttgttatatagggacccagaggtccttcatcattttcaaacacatcaacagatatttatagcaaggccacaattaataaaatgtttcccagaatatatgtgtgtgttacatttagaggaaacagaagtagtattgacttgtttctatcaccagaggtctatttagtaactatattttgtggaaaatatcgatatattttatccattcaacagacatgatttgagagcataccacggagacccaaccctgccagtgtggcaggtggtataatagaagaaaatagcaaacttggtgtatctgtgtttgcgcacatgtatgtatgtgaggggcactaaggatgactttacagaggttggaacttttgagtagagttgccaagatagggagagttcactaggaaaacagaagggaagttgatttttttttttttttgaaatggagtcttgctgtgtcgcccaggctggagtgcagtggtacaatctcggctcactgcaacctccgcctcctgggttcaagtgattcttctgcctcagccttccaagtagctgggattacaggtgcgcgccaccatgcccagctaatttttgtatttttagtagagacagggtttcaccatattggccgggctggtcttgaactccttacctcatgatctgcctgcctcggccttccaaagtgctggaattacaggtgtgagccactgctcctggcccggaagttgatattcaaacaggagcagcatatgcaaagacagtgagctctgagagagtagatggatccagactcctattgctgatagcgtcctgcaggattgggcttcaatgtgactaacctacaattgcctccaggtgctccacccactgagtccttgtgtctctgctgaggtccttggagagttactggagagggctctgtgtcagatgaccttgaggaggctctgatttagccttttgtaaaatgcaaagagttgaggtcttctccacgcaagagctcgctgatgtcaatgaggtattgaggatggggccatctcctatttctgtggccagtactgagttttgttatccttcctttaggtaaggagtgccaatggaccgatgcctgcctgtctcatccctgtgcaaatggaagtacctgtaccactgtggccaaccagttctcctgcaaatgcctcacaggcttcacagggcagaagtgtgagactgatgtcaatgagtgtgacattccaggacactgccagcatggtggcacctgcctcaacctgcctggttcctaccagtgccagtgccttcagggcttcacaggccagtactgtgacagcctgtatgtgccctgtgcaccctcgccttgtgtcaatggaggcacctgtcggcagactggtgacttcacttttgagtgcaactgccttccaggtaaggagctccctagtgtcccaggattaggggacaaacccctagcacaggaggtagtgggtgtggctcaattgctttttttaggaagcgcaaggaaaaagggaagtgagaattttgtgtggggtgggttgctagtgagggaggagttttatgggcccactgtggtccataaactgagcaggggataatttagcatgtcagggtttatgatgatgagtggctagaaaattgtttattgtcccttttgtagaaacagtgagaagaggaacagagctctgggaaagagacagggaagtctggaatggaaaagaacacgatgagaattagacactggaaaatatgtatgtgtggttaataaagtgctttaaactgaattgacattaacagtgggtgatcaactttactatgtgcttgtgcttttgcttttgatggagtaattcattgttttcttatccacctaaatgcacccagctgcccttgattttctctgggctactggccttcacaaccctctcccatgtaccctctctgactttggggtaaccctcccctaacttaaagctagagaattctgaaactgaggaggggatcctctgttaatcagtgagcactttttgatgagctgatagatgatatatgagagactatgcgtggcacaatactttgttacactcttcactgatacaagtgttctagagtgtacacacaacccaaagatagaaataaaaagaggagcagtgtcggggagcttggggcctggtgttccatggagagggagaaaggaacaagcttgaccaattcattcaactccttataaaaatgatgaggaggctgaaaaccaagaattttgattgggaacagaatacaagcagctgaatcagatgaattactaagcaacaaagatcctgtttttatacaaatatccttagtacaaaaacaaaagaaggaaaactgtaggggggagtaatgtgctaagtaagcagaattgcctcaaaaagaagttgttctagttactctttcagagtgggaatcttagattctggtattgtggatatggttcacatataatgggattgtgtgttttattttggagggattaaaggtcatagtttggtcctcagtataaaatcaactggtaatttattcatttcatttggtaaaaatgtattgactgcctgctatgttctaggcaccatgctatgtatttggaatacagctatacaaagcattgtcacataattgaaatgaaaattttatattatttaagtcacaagaacaagctatttaattatattacttttagtttctcttttaataaagaatagataatgctatcattctagatactaaataagtattttcttaacataatattactatccactttatcttgtagaagaaataactaaaatacatctgtcttcactcctgtatttgtttgcattttaaggattaaagacagaaatagaaatgtaaacaactttattttgaaaatatttcaacactgcaaatatctctgggtctgatattctagtaatctaattggctagtaattgatgttagtgtgatttattgttgaaggctaaatgtgtttttcagtttcaagaaaattgcttttaataattgcctagaacaagaggttgatttggcagcaagatgttgacgggaagttagagaagtcaataaaggaagtttttagctgagagagagtgattattcactcccatagcctctgcattgttatccattagccacgataagaaccttagggaattctgagagtgtgtccaggaaaggatctgtcaaactagaatagtatctcctccttgagaaaggaaataaccaaggattccgcagctgagaggctgccagggctagtgaaatagagtaaggaaatcttggctgtctcttattctctggttgtagtttaacgcaagacacttatttactcactgatggtgtgtgtgtgtgtgggaggggagattagcatgaggggtgggaatggggagattcgatgaagagaaaactaacatttttttggtgactcaggaactgtgccaggtacttccatgcttattagctcaattacacaaaaatcttgggaccaggtattatttttcaagtcttcccacatgaagtaactgaagtttggagatgttaagtgattcacccaaagttgtacagctaatatgtggttaggctgggtcctgaaaccgaggcagtttattttcaaagcctttgctttgtgcatcttactgcgccacattgcactgcacatctgcttcctgaaagcactttgtaggtgtgtaaaacttttcgttaaatgctttaagctgtttgggttaaaaatatatgttcatgttataagaaaaccaagacactcctaattataatcaaatagtacttgttacatatcaatatgtgtgtgtgtgtgtgtgtgtgtgtgtgtgtgtgtgtgtgtgtgtgtatggcgttgtgcagatgtttaaaagtagttacatagactagttcttgcttttcagggtcccataatctaaaccagatgacttcagctttggataaatatatagaaggaaatttaaagagaattcaaaacaatagatgatgcagtgacactgtgaataaatgttatttatacagtttgtaagatttcatgctcattgttcatatgtcccaggtggagttcagaaaatattctcttcatttccacaaaggggaatagtgcctggagatggttttcttttaaaaagtccttttcataatgcagtgcccttccttccattgcccttcattccattgcttcccatgcttgtcaagagactaaaatgttacttatagtaatagtcactatctcaatgtaaatagcacccttatttgatgagaattattatttcagttctaaaaatggggaaacaaagtcagcaggaggcaaagtagcttgttaaagtattctgcaactttcaaatggttgcttccactgcatttcacgtcttggcacttctaattgagggttactctaaccaccctatttaaaattgtaactgtcccccacccccttaattactaaccctggtctactttttgttttctttttctgtaactcttatcttcttactatataatttatactatataatttacttcattatgtctattgttcattgtctgtcttttccaaattctactgcctcttaccctctccagaatgaaaactagtatctttgtttttgtttactgatgtaacccaaacacctacaaacagtgcccagtatatactaggcccacaaatatatattggctgactgactgtatggtttagtatcatgtcatagtattgagactgtaactttggtcttctcattttcttctttgtattgtgcgtcctagacttagtttggcctctccttttgtccttgtatactctaatactggataagaattttggagtctttttcaactctgagtcagtgaatgccacataacttagtgactatatttaaatggttaatttacaattttttccctgcaaaggatactgtagtcactgtgagtattttagtattattgtaggactcaagagggaattaaaactacaaaaatgactcctcttgtatgacacagaaagaaatgtttcttcacagagggaggagaaaaatatcttcaagagagaactaatagaatcaaatcaatgaaccatgtctcatctttttggataagtaactgttagtaatccagacacttcatgagctttcattatgtaaagtctttagcagaagctaaaggaggggcaccaaccacagtaattttaacttaagaacaaaatggagcatgaaaataaattattaaatcatttactcccactatttttgggttagggccaataatggggagagaaagaggtagactagttttgtgtttgtggctattttaatagagtagcacaagtaatcaaaaaacagtaggctgttttgaatttactggctgtcccttatgagttcacagttagattggactgtcctcaatgtactttcttttttttctttctttcccacatctctttatttctctgattttgtttaaacttcataaagagctctctgatctttcctttccaaacaatgaaggtttatcctttgtaaactacctctgtactccacaggctgatgatatgtgatatccctatatcattaaagtaaagcctaagcacattctatggcttttgtgtctactctgttgttgctgagcttatgaactattagaaataactccctcttgcattttcacacatggggaatgtgatgttctcttgggtattatgctaatcatattttggcaggtttctctggagcagatgcagaaatgatcataccactttccagggtgtattattttagctcctttgacttgggccctaagtctgttttacctgatgttcctgaaagatgttcctgatgtccttcactgttctttcatgctggatgttcttgcctatgctgcctcctcagctatcaccctctcttcccctttttaatgtagaactcattcttaatgatttgtcaaaggcaccctatttcactgaaatgccttctatattccctaccctccaagtggattgtagaccttctaaggtcttttgacatctgcatatctctagcacagcacttatcacggtgattatttatctgttcatctttccaagtagacactctcattttaactccctaccctagtcgccagcatccccagcatagtgcctgtcataaaatggtgccacaatgaaaatttgaaaaatgaatgaacgtgataaacatagatgagaatcctatattctacaattttttaaatgtactgaaattattctttttgaatcctcctatttatttctgtgacttctttgatgacaaagttagaaaaaagtggaggtcagtagggagatatgaagggacgcaggtggaagcagtgagcctgggcgggtgatggagtgggagatacgtggcacaggggtcagtgagttaatctgggctcattcagagaatggaaggtgtgtgccaagaaaactggttggatagggataggtcagggattccctcttgcattctcacacttgggggcatgtgtcattttcttttcttttcttttttttttttttttttttgagacggagcatcgctctttctcccaggctggagtgcaatggtgctatctcggctcactgcaacctccacctcccgggttcaagctattctcatgtctcagccttccaagtagctgggactacaggtgcctgccaccatgctcagctaatttttgtatttttagtagagatggggtttcaccatgttggtcacgttggcctcgaactcctgatctcaggtgatccacctgcctcggcttctcaaagtgctgggattccaggcatgagccaccatgcctggccgcatgtgtcattttcttgggtgttatactgatcgtatatttgcaggtttgcttttgtgacagacttcttctgggggaaaaaaagtatccttctatctttttacttttgtccagttccaggtatccctgtttttttcttcactcttccttccttgttcatgggagtttttcttgaggacttcaagcccagcttcggagaatcctggttgtgtcatctcatctcctttctgctctcttctctacctagcctttccaccctcacacctcccggggtctgaaaatggaaagataagggtgtttccctgaaagttgctcttctgtgtggggatgacaggttctaaagactcttttctggtccctgccctcattgccatgattaatcagttaagtggcccgaggttttataacagcacagtcttaaaatgcttctcccaagtttaatttctctccatttgaccttttaaggatgtgaattggctttaagcagtagactccctttagtacggtgctgtgagcctctcagtgaatctgctacatccattccacccacgggtctggaaacttgtctgtttacctttccctaaaaacctaagatatatttttaagaagtgccttgtaacttttcatatagcctttcccctactttgggtagactgtttcttacaggaatttggtagatctttccaaagagaattctgtatctgtatttttaaagcataaatcctgtcaactttggaggagaactgatttggcttgagttttctcagacatgggaacttttgacctaagtttgtattttacattgttgaaagggaactccgggatcccagaaaacatatggactgcaattgggtaaagtttctgttccagaaatgcctcttctggacatttcatacaaatggaaacatgcagcatgtagtaatttatgacagcttctttcacttagcatgaggttttcaaagttcattgatgtggtagcatttgtcagtactctgtgcctttttatggctgaataatattttatcatatggatttaccacattttatcattttatttatccatcatcagttgattgacatttgagttgcttctactttttgagtattatcaataattctgttatgaacattcttgtataattttttggtagacatttatcttcatatttcttggatatatacctaggagcagaattgctgcgtcagatggtaatgctgtttaaccttttcaggaactgtcagactgttctgaagtgggtacattattttacattccaaccagcagtgtatgagaattccagtttctccacatcctcatcaacagttgttattgtctgtcttttttattatattcatctgtaatgtgaagtgtttatctcattgtggttttgatttacatttccctgatggttgatgattttcaacatcttttcatatacttattagtcattatgtatcttctttggagaatgtctgttcagatcctttacctactttataattggtttatctttttaatattgaactgtaatagtttttaaaaaatatatcctaaatacaagtctcttatcagataatatgatttgcagatattttctgtcattctatgtactgtcttttcacattcttgatgatatacttttcagcccaaatgtttttaacttgatggaatacaatttattttttcttttgttgcttgtgctttcagtcatatttgtgaaaactttgcttatcccacattacaaagatttactatttctaagtgatttataattttaccacctacctttaggtctctgatccattttgagttaatttttatgtgcgaggagggagtctaacttgattcttttacatgtggatatttagttgtcccaggaccatttgttgaattaagtgcccagaacaagtacatctatatatagagaaagtagattagtggttgtcagagactgtaagaagtggggaattggagagtgactgcccataggtacaggcatgctttttggcattatgaaaatattctggaattaggtagtggtgatggttgcagaacttttggaatatggtaaaagacactgaaatatatgcttaaaaatggtgatttttgtgatatatgaattatactatagaactaataataacagtaataaagcaaggtgtctttccacatctccatgccttgtattttcattaaaaaaaaaaaaaaaaaagcatttcagggccaggctcagtggtttactcttgtaatcccagcacttttggaggcctaggtgggaggatcacttgaggccagaagttcaaaaccagcctgagcaacatagcaagaccttgtctccatgaaaaataaaaaattagccagaaatggtgatgtgtgcctagagttccaactacttggaaagctgaggcaagaggatcgcttgagcctaggagttcaaggttgcagtgatctataatcaccactgcactccagcctgggtgacagaacaagaccctgtctcaaaaaaaaaaaaaaaaaaaaaaaaaaggcatctcactttaatagtaagaggccagaatatgatgctggcagcatgttgtgaggaaatgtattagatgaaagaagttaaattccagttctccttttttcagaaatgaggtataggggagagaaacacgtactttgaaagaattgacccagctgaattggaaaatgtgggaaggggatggggaagaggctgctccacctgagatctggctccaggacttacagcaaggggaacttgggcaagttacagactgtctatgcctcagtttctttatcagcaaaacagaatcatcccataaactataaggtcgatggtatcagcgggtccccaaactgactgcacatctgagtcatgttaacaaacacattccaggccccacctgagccctctgaatcagaatccctgtaaggaggatgatgaacttgaatttgcactgactttcccagctgtttcttactctgatcaacttgggggtaggacccattgagctgcatcacatcattccaaagccaaaacacaacagcaggacaagaatattttcaaggcagtctctaaagcagaggagaaactgttgagggaacttagaagtaaaggagatctggcttgctgggctccatttgaactttgagtacaacagagacatgagcccttcgggacacatgcctgaggtagtgacaatccaactttggaagagtggaagccctagtttcaaattcaagcatgctttgagtataaattaagtttacctctttttgcacagcaacatggccaatctttcctaagctgctcagcttacaagaaaaggaatcatactgctaagaattcaaacttcagcagtcataggtaagtaaggaagtcttataaacctattctagccacctaaccagaaactcgaaatttagcaggttctttcagtttcaggacagttgtgttcactagatcagaggcattgagacatgaagaacagacccttaaaaagggaaagtgttcccttcagtttgaggacatcactggaacattagggaagtgggaacacagctgctcactctacagtgtgggttgcctttgtgtctggaatgtgtctgacgtcctgatccctgtgcacatttcagggagccttgggaggaccccgaatcactgatggaattgcgcagtgcatggagatggctcagcaggatgagggtaaatgcaggggcaagtccaggccatactgagagacaatgagtggcgctgatgaggacaaagataaaatcaaaagtttgtgcttcatcttcaaaaactcaagctgataacaaacttggcctgatgagaaataataagtatttttctatttacatgagaatttaatctcaaaacagaaatcagaaaaatatgaagtccagggcataaaacctaaaactattgctcatatttattctttctaaatagagcaaagtgtaaaatcttctccataagacatacattgtggttataaaaaggcaaaagtcttagtgagaatcattggtattccatagaagagtgaattaaacacagccaagggaagacccacgtctcatacttctcttgtatattccaaagttccagggaaattccaggtgatagaggttatttcccatactgttaaagcaaggtttcagacacttctgaattttggtcccagtactctagaagggcacacctctgtcctggaaaataatacaggaatgaatactcttcccgtgacccattctggtcattcttccagcatcacaaaaaccaaaaaatggaaatatggccaaatacgtgattagctgtccctcatcttcaggtttcttatctgttacttatagataatagcattaccttaaggattatgatgaagatacaatgtccaaatataaacacagttttgagcaaaatgccttgtacgaattggtcaatgaataattactaaatatgtgaatatttctggattgtatggatcctatgaataattactgaataattattgtgattgcttttattggcagtgctgaaaactcatccctttgtgacctcaagtaacccatgacactttgtgaacctgcagttttttcatttagaaacttgacagattttcattctgacacagaatgtcaggtctcccagaccctagaaaatacattgacttaaagcctttgatacatctcaaagcagtatccttacagtgtcactggaagatggtgcgggctgcagagagggatgctttcaaatgggattaaccagtcctccttccttcacttccacatgaatgctgggcagcccagggtcaacccactgcaccctcaactcaggcaagtccagcagccaatcttaggagacctgggctacagaacagtctctcaagttccaggctcacaaaacctaggtggggatgaaagctgagaaagcgaagaggtggttcaggggatcactctttcctacttgttcctctcacctcaaactcaccttctactgcacagcaacactgaggatcgccaaccaaccctgaccataaccttgatcttgccatgttctgttagtggaatgcaacccaaaatcaatggtgttaggtcatctcaacaaaatatatatcaaaccatattccataagaactgctcgtggccctgttcttttcagtatatgggaaaacaaaatggaaacaacaaaatagcatcaggtttacaaaacttcccaagatagatggtcacacatgttttcaggagacctctatataaatgactttgatcacttgataccttgaaaagaggtcttggggcactagaatgacatctataagtgacaagtataaaatgtagtgctcagtgacattaaaaaacaaatcaacccacatagaggaagagctttggacgtagggatgtcaaactggtctagaatgtaatgaaaacccaagaaggtgccccagtaagaaagaagaaatcaatctaacaatgggatgcagcagcaagaatactgagacaggaaagaaaatattttaaaaaaatgaattattcattcactttctagtggatacagaaaaaactgcagaagacccggaggatatcagggcaggctaaaagtttgatatcttacacctgtggaaaagccttaagctctgttttaactgagagcaggtggggtgacttcatgactaccattaagaaaatataacctgttgggaaactgtttctgccttgatgatgttgtacagacaagagataaacagtgaggaatatgcttagatgtattgggaaagacacgggtctgtggcattgtcacaagggtacacgaatactgagagtgaatgctgaaggaatgatccccattggtggtgaccctcaggtgagagtagggtgcctgtgtttcagcaaagcctgggcaattggaatgcagagctcctaagattccatgacacccccaccttctaattctgttattgcaactgcagacggttacctggcacgctggccacattctgcctcactcttatcagagtctgagctactggcagtgctttcagctctgagttgaggcacctcgaaccttgtttttgtggtgaaggatcctaaagtgctgtggggagtgatcacatttttcacaacagtaagttaagaatttcagttactgacatccctcagtcctgattaaaccgatttgatttcaccagtttttaacccatcatatgtttgggtttcttctccccagtccctgactccacctcttctgccacaaacgtcagcatggtggtatcagccggcccttggtccagtgagaaggcagagatgaacattctagaaatcaacgagacattgcgcccccagctggcagagaagaaacagcagttcagaaacctcaaagagaaatgttttctaactcaactggccggcttcctggccaaccgacagaagaaatacagtaagatctataggctcaccatcatgaaagtgatgaatgatatcctgtcttctctctgagacactaaatgctctctccatcaaaaataatttcatccttcctgtacttctaggaaaacagaaatgggtattttaacattttgttaaagttggaagacagaggtgccaaagtatttagcaactttccatgtttgcaatcagatgggggtggaactagagttaaactcacagttattgatttctaacacaggcacagaatgacctgttttctccaaggggctcaatcatgtttttaagaatcctctctgtaccatataagatcctgcagacaaataacatctagtctgttgttctaaatgtctaggactagtgaacttttattcagttcaagtttctgttgaggcccaacaggcaaagctctgttctagtgactctgaggggaacttggtgatagtagccagtacctgctctgaggggcttcaaggggagtctgctcctaatagaacctgtgctatctataagtgacagcatcaagagcagggagtaggggccgtgcaacgtggctcactcctataatctcagcactttgggaggctgaggcgggcagagcacgaggtcagcagtttgagactagcctgggcaacgtggagaaaccccatctccactaaaaatacaaaaagtagatgggcatcgtggcgggcaactgtaatcaccactaatcgggaggctgaggcagaagaatcctttgaacccagcaggcagatgttgcagtgagccaagattgcactattgcactccagcatgggtgacggggcaagactcgtcaaaaaacaaacaaacaaaacgataaataaatcaaaaataaaaataaaaagcagagagtaccttggtgagagtgaagtcctgcttcctggtgcacaggctcttgttcctaaagaggaaagatcacaccggagaatgtgtggaagcagcagtgcagtgtgcaaagcagggaccctcagcctgtctcctgggctccatccaagttgcttgtcttgtctgtccctcagtttcctcatctgttcagagggtactacaataatacctacctctgtaaattgctgcaatgaattacctgaggtatttcctgtcaatctccttgaacattaattggcacagtgtaaacactatctattagttcttcattctgatgtttctaaattaacacaaactaatcttatgctgtttctaaattaacacaactaatctaaatcttaatgctgcctctcatactaataaagtatttgggcatatttccttcatggccttattgtcttatgtctcacactttatgcttcagatatgattcttaaaaccatatctgaatattgatttaaaagtgaaatatttttaaagtccttgacatatttgtccttgaaatacccaataaaagggaagtcatcagtcccatagtcctaggggccttcccgactgtacaagaaatcactacttcatgccccagtgcagtgttttagaggagaggctgcaaggcttgggaaagtggccccgcattcagagtcagacctcaggggctgtgagttctgactccacttcgttgtggttgaatcatcttgtcaacttccttgatgtgcccttgagtttctcttttttcgtctttaaattttggaggatcagatgccagaaagtcaggagactgaagagtaaagatgtggaaatccctgtctagaccctggtactggggagagttttgtccttgggatggacctggctcctgccctgtaggcagtgaccacagcagcatgtccagccttccactgaggcaggcgtgtctgtcttttttcagagtatgaagagtgtaaagacctcataaaatttatgctgaggaatgagcgacagttcaaggaggagaagcttgcagagcagctgaagcaagctgaggagctcaggtgaggggaccccatagggggaggcaggcgggtaggtgtgtagatctctgaagtacagcagctcggcggggagaagtaagaacgaagctgggccaggggaagggcagaaattgccatggcaggctcatgacacacaaatatttatcagagagcaaggataataataagttctgtgttgcagttgtttcttagagccttgttttctctttttcaaacaagtaattgttgatgtgaaatttacataacacaaaattcaccaaaggagtgggaaccacccagcagcattcagtataatcaaaatggtgtgctatcgccaccccacttacccttagtgagcatcacctcctgactgactgcgtcttctcattctttcactcaatcaatgttgcctcctcgaccctgtccttcttttcttctttcatcttttcaattcgccccatctgcacctggcctcatttctgtacgtggctttgtatctagtggccgcaagatgcactatgtgtattttcacatggaaatgtccatggccagagtgaggaactgaaaggatgtctttttgaaacggaattaggaagacacctacttttgtttacagaagagaaagatgaatggaacatcatcgaggatcttgcaggagccctctctgatagagggaaagcctgtagaccattttctattctttctcttggccacagtcattcctttcaacatgtgctgaccttctgcttggaggtctccttgacgacattgtctcagaagtctctgttgcaatatttgaacggatcactcaaccctttctactcttaaattttctctaccgtctcaccttaggcaatataaagtcctagttcactctcaggaacgagagctgacccagctaagggagaagttacgggaagggagagatgcctcccgctcattgtatgagcatctccaggccctcctcactccggatgagccggacaagtcccaggggcaggacctccaagaacagctggctgaggggtgtagactggcacagcaccttgtccaaaagctcagcccaggtaaggtggccataggccctgatgacccaaaaccccaggcttatgagaggctccagacctccatactttcacaatgacagttgtatcagtggggtttttttctactacacctatgtggccatgacatgatcaggacttcctgggtaagaacagagatgggaaacccatgggtttggaggtcacagtattgcaagtgtccctccttccttgatggaaggtggtctttggagcaagaggcagcatctatctagttttaaaggacaggaaggaggctgtgatggaagggtgcttgttggagtgaaaagagctctgggctaagaatgaaggttcccaggctgtatttttggcaatgttcttagtaagtgtcagtgagtgatttatcttttcagagtttctctctctccatctgcaaaggcagacaaattgtctcttgcaagggtctgaagcatccaaatatgggaacacttacgaatgcttttcaaaatgagatgaagcccctctccatgtggtgttggagaaggcacttgatgtgggggcatttggtggtaggaagtgcttcagactggagcactccccatggatagaatgtccctgaataacacagcagaagccacatggagggcctgtgcagtctcatgacgcatagaggactgtgggacaagtttgtcctctcctaagagaaagaatgaggtttgaaatgcgaactgtgacaggacaccaagcctgttcctgggaatcagatctgtggcaggatgggggagacagctgccaaagtccagagagaggctgcacaagcctccagtgatatgggaagcaaaaggtcttttcggtatttggccacatcttgatggtggccctccacatcagaaatgcattgcccgatggagcaggaaaccatgccagggcattttgtgaaagataaaacatgagagttttcagtacaatgctgaaccatacatagatgttcatgtctctgtgcacgttgggctgactgtgcttgcagaatgtgaagtgggaaatatctgaacgaacattttgtatttctagaaaatgacgaagatgaggatgaagatgttcaagttgaggaggctgagaaagtactggaatcatctgcccccaggtaacactgaatactcaggagcaagtaatgggtggtaacgtatgaaaatgtctaggaggcacaccctctctggcatctatgatgggccaaatgcccgcattcccttggccacagtatgtgaaattgaacccagcttagacacagggtgcggcagctgtcgtgtttctctatgtgtgccaagtgtcatgtctgtaccatgcagggatagctgagtcttcatcctcctcagctcctatctgttcagtgcactgaacaccagctgctctcttcctctctggctcccatggcagccatggtctgttgcagagagaagaggattgcctgttccctctttaagggaacctccgttttgctttctggaaccactctcttaatgccgcctgtcaaaaccagctaggactccctggggtccaatccctctgtgtttaatcttctgtcatctctgtcccacctggctcatcagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccaggtagcctctattttccttgtgtctcatacctctgtctaggctatggaagatcaattctgaggacaggctgtatatacacatattgttattgttttagtcagaaactaggatggagctaggtgctgtgactcacacatataatcacagcactttggaaggcccaagtgggacgatgacttgagttcaggagttgaagaccagcctacacaatatggtgaaacccatctttacaaagaatacaaaaaattaggcaggcatggtgctgcacgcctatagtcccaactgctcaggagacttaggtgggaggatgggctgagatgatcctcccactctcattcacttctgtcaggctagactctctctccttttcattggcttgtcttagctattaataagtctcggctgggcgcagtgggtcacacctgtaatccgagcactttgggaggccgaggcgggtggatcatgaggtcaggagattgagaccatcctggctaacacggtgaaaccccgtctttactaaaaatacaaaaaaaaaaaaaaaaatagctgggcgtggtggtgggcgcctgtagtcccagctactcaggaggctgaggcaggagaatggcatgaacccaggaaccggagcttgcagtgagccgagattgtgccactgcactccagcctgggagacagagcgagactccatctcaaaaaaaaaaaaaaaaaaaaaaaaagtaagtctctgaccaggggcgctggctcacatcttaatcccagcactttgggaggctgaggtgggcggaacacctgagctcaggagttcgaaaccagcctgtccaagatggcgaaaccccgtctctactaaaaatacaaaaattagctggcatgttacttggcgcttgtaatcccagatgcttggcaggctgagggatgagaatcgcttgaacccgggcggcagaggtggcagtgagctgagattgtgcctctgcactgcagcctgcgtgacagagtgagactccgtctcaaacaaaaaacaaaaaaccaaaaaagaaaaaaattaaaaaagcaaaatgaaatcttttgtgctacacagaaacattggccactcatggggtaaaaatctcagggccaagccttgctttatagaaacgtataagcaagaaaagtgtagaagtgtttatgtcctggtttcaaggtgactgcatagctaagacaagttgacttaaaggagatcaagactggagatgacaagagtgaaaccagggaaacatcatcttcaaataagtaaacaaggctgccagtgacatccctcagtcctgattaagcctatttgatttcaccagtttttaacccatcatgtgtttgcctttcttctccccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactgtccggcttcctggccaaccaacagaagaaatacagtaagatctataggctcaccatcatgaaagtgatgaatgatatcctgtcttctctctgagacactaaatgctctctccatcaaaaataatttcatccttcctgtacttctaggaaaacagaaatgggtattttaacattttgtcaaaattggaagatagaggtaccaaagtatttagcaactttccatgtttgcaatcaggtgggggtgggactagagttaaactgccatttattgatttctgacacaggcacagaatgacctgttttctccaagaggctcaatcgtgttttcaagaatcctctctgtaccatataagatcctgcagacaaataacatctagtctgttgttctaaatgtctgagactagtgaacttttattcagttcaagtttctgttgaggcccaacaggcaaagctctgttctagtgactctgaggggaacttggtgatagtagccagtacctgctctgaggggcttcaagaggagtctactcctaatagaacctgtgctgtctataagtgacagcatcaagagcagggagtaggggccgtgcatggtggctcactcctgtaatcccagcactttgggaggctgaggcgggcagatcatgaggtcaggagtttgagaccagcctgggcaacatggagaaaccccatctccactaaaaatacaaaaagtagatgggcgtggtggcaggtgactgtaatcacccctgctcaggaggctgaggcaggagaatcctttgaacccaggaggctgaggttgcagtgagccaagattttgccattgcactccagcctgggcgacagggcaagactgttaaaaataataataataataatgataaataaaaataagaataaaaagcagagagtagcttggtgagagtgaagtcctgcttcctggggcacagagtcttgttgctaaagaggaagaaagatcgcacccgagaatgtgtggagatagcagtgcagtgtacagagcagggaccgtgggcctgtctcctgggctccatccaagttgcttgtcttgtctgtccctcagtttcctcacctgttcagagggtactacaataatacctacctctgtaaattgctgcagtgaattacatgagctatttcttgtcaatctcctagaacatttattggcacacagtaaacactatctattagttcttcattctgctgtttctaaattaacacaaactttattagcatttgggcatatttccttcatggccttatggtgttatgtgtcacactttatgcttcagatatgattcttaaaatcataactgaagatatgatttaaaaatcaaagattttaaaaatctttcgcatacttgtccttgaaattcccagtaaaagggaaaccatcagtcccatagtcctaggggccttcccgactgtacaagaaatcactacttcatgccccagtgcagtgttttagaggagaggctgcaaggcttgggaaagtggccccgcattcagagtcagacctcagggactgtgaattctgactccacttcattgtggttgaatcatcttgtcaacttccttgatgtgcccttgaggttctctttcttcatctctaaattttggaggatcagatgccagaaagtcaggagactgaagagtaaagatgtggaaatccctgtctagaccctggtactggggagagttttgtccttgggatggacctggctcctgtcctgtaggcaatgaccacagcagcatgtccagccttccactgaggcaggtgtgtctgtcttttctcagaatatgaagagtgcaaagacctcataaaatttatgctgaggaatgagcgacagttcaaggaggagaagcttgcagagcagctcaagcaagctgaggagctcaggtgaggggaccccatgggggcaggcaggggcgcaggtgtgtaaatctctgaagtacagcagctcggtggggagacgtaagagctaagctgggccaggggaagggcaggaattgccatggcaggctcgctacacacaaatatttatcagagaagaaggatagtaaaaatgtatgggttgcagttgtttctcagagccttgttttctctttttcaaacaagtaattgttgatgtgaaatttacataacacaaaattaaccaaaggagtgtgaaccacacagcagcattcagtatactcaaaatggtgtgccatcaccaccccacttacccttagtgagaatcacctcctgactgactgcggcttctcattctttcactcaatcaatgttgccttctcgaccctgtccttcttttcttctttcatcttttcaattcgccccatctgcacctggcctcatttctgtacatggctttgtatctagtggccgcaagatgcactatgtgtattttcacatggaaatgtccatggccagagtgaggaactgaaaggatgtctttttgaaacggaattaggaagacacctacttttgtttacagaagagaaagatgaatggaacatcatcgaggatcttgcaagagccctctctgatacagaggaagcctgtaaaccattttctattctttgtcttggccacagacattcctttccacatgtgctgaccttctgcttcgaggtctccttgaggacattgtctcagaaatctctgttgcaatatttgagcggatcactcaaccctttccactcttaaattttctctaccgtctcaccttaggcaatataaagtcctggttcacgctcaggaacgagagctgacccagttaaaggagaagttacgggaagggagagatgcctcccgctcattgaatgagcatctccaggccctcctcactccgtatgagccggacaagtcccaggggcaggacctccaagaacagctggctgaggggtgtagactggcacagcaccttgtccaaaagctcagcccaggtaaggtggccataggccctgatgacccaaaatcccaggcttatgagagactccagacctccatactttcacaatgacagttgtatcaatggtgtttttttccactaagcttatgtggccatgacatgaccaggacttcttgggtaagaacggagatgggaaacccatggggttggaggtcacagtattgcaagtgtccctcctcccttgatgaaaggtggtctttggagcaagaggcagcatctgtctagttttaaaggacaggaaggaggctgcgatgggagcaggcttgttagagtgaaaagagctcaggactaagaatgaaggttcccaggctgtcttttcggcaatgttcttagtaactgtcagagagtgaatgacttgtccttcctgagtttctctctctccgtggcagacaaattgtctcttgcaagggtctgaagcattcaaatgtgggaacacttacaactgctttccaaaatgagatgaaggcccttgccgtgtgatgttggagaaggcactttatgtgggggcgttttgtggtaggaagtgcttcagactggagcactccccatggatagaatgtccctgaagaacacagcagaagccacttggaggcttgaaatcttctgatgcatagaggactgtgggacaagtttgtctgcttctaagagaaagaatgaggtttgaaatgcaaaccgtgacaggacaccaagcctgtgcctgggaatcagatctggcaggatgggggagacagctgccaacgtccagagagaggctgcacaagcctccagtgatatgggaagcaaaaggtcttttcaatatttggccacatgttgatggtggccctccagatcagaaatgcattgcctgatggatcaggaaaccatggcagggcattctgttaaagataaaacatgagagttttcagttgaacggtgacccatgcctagatgttcatgtctctgttgcacattgggctgactgtgcttgcagactgtgaagtgggaaatacctgaacgaacacttctgtatttgcagaaaatgacaacgatgacgatgaagatgttcaagttgaggtggctgagaaagtgcagaaatcatctgcccccaggtaacactgaatactcaggaacaattaatggatggtaacatatgaggaatatctaggaggcacaccctctctggcatctatgatgggccaaaaacccgcattcgcttggccacagtatgtgaaatataatccagcttagacacagggtgcggtagctgtcatgtttctctatgtgtgctgagtgtcatgtctgcaccgtacagggatagctgagtcttcatcctcctcagctcctatctgtccagtgcaatgaacagcagctgctctcttcctctctggttcccatggcagccatgctctgttgcagagagaacaggattgcatgttccctcttaatgggaacctccattttgctttctgggaccactctcttaatgccgcctgtcaaaaccagctaggactccctggggtccaatccctctgtgtttaatcttctgtcatctctgtcccacctggctcatcagggagatgcagaaggctgaagaaaaggaagtccctgaggactcactggaggaatgtgccatcacttattcaaatagccatggctcttatgactccaaccagccacataggaaaaccaaaatcacatttgaggaagacaaagtcgactcaactctcattggctcatcctctcatgttgaatgggaggatgctgtacacattattccaggtagcctctgttttccttgtgtctcatacctctctctaggctgagaaagataaactctgaagacaggctctataaacacaaattcatttgaataaaaaactgtgatgggtttctaaacagatatcagggagtttgtttgtccttctcagctaatgtcatgactttgtctgccagtccccagtatcaagttactcaaccccaggcaagtgtgacaatctcatagtcacctgagtgcaggaggtgcacaggcagtatctgtcaggcctcctagcttcgattcagtatctcttgtcatctgtgattaagtcatctgtccctgaacaatgtccatggagtttctatgcctgtttaaggaagctggcagccttgcctttgtatttggaaatattgttccccaggcttcactgctctcagctttcatctggatctcctttaagtcagcttgcttagctgcacagtcaccctgaaatcaggacggaaacttttcttctttactttgctgatatatttccataaagcaaggctggaccctggttctccaccctgtcaatgcaatggctgatccaatgtttctttgtagcatcgtggatttttttttttttttttttttttttttgcaatggagtcttgctctgtcacccaggctggagtgcagtggcaccatcttggcttggtgcaacctctgcctcccagattcaagtgattctcctgcctcagcctcctgagttgctgggaccacaggtgcacaacatcacatctggctaatttttgtatttttagtagagacagggtttccccatattggccagggtagtcctgaactcatgacctcaaatgattcacctgtcttggcctcccaaatcacagattctttttaaagcaagagttgttcaaatttatctatcagtcgtgtttcatgtatagatgcctctaaacatttaatgtccatgttacctggtgatataagtccgtatcgcagcaacactcttagaaaattgtttgaccaatttttggagatttttttggggaaaaaattttgtttaactttgactcaggcagggaatatggcattatggtctacacgtagagggagattttggcctgtgggtctggaaagcagggtcatctaattctcaccaaagttaatctaggacaccctagaatattcctgtcagaatccttattcttgcactgagaatagttatgtccttgtgctatgactggacagtgatttgttcatatgtgaagtatgaattgcttaatgtgacctgcttctctgaatttatttacagaaaatgaaagtgatgatgaggaagaggaagaaaaagggccagtgtctcccaggtaatgttgtggaattgttggctgttaattcagtagtgacatctggagattgtagatttagggaaaatgaggaagtgatgaatagaactatttcttccattcacccagctacaaattgtgctgatttacaatgttgtatgttatttgtggcacttgtattggttttaatttcatagtcctctcaagataggaacttgccatcagatgagccaggtgaactagccaaacagggttttcttgttgatcttttcaaaaaaccagccctggattcattgattttttgaagggttttttgtgtctctatctcctttagttctgctctgatcttagttacttcttgtcttctgctagcttttgaatttgtttgctttgcttctctagttattttaattgtgatgttagggtgtcaattttagatcttttctgctttctcttgtgggcatttagtgctataattttccctctacacattgctttaaatgtgtcccagagattctggtatgttgtgtctttgttctcattggtttcaaagaacatctttatttctgccttcattttgttattttcccagtagtcattcaggagcaggttgttcagtttccatgtagttgtgtggttttgagtgagtttcttaatcctgagttctaatttgattgcactgtggtctgacagtttgttgtgatttccattcttttacatttgctgacgagtgctttacctccaactatgtggtcaattttggaataagtgtgatgtggtgctgagaagaatgtatattctgttgatttggggtggagagttctgtagatgtcttttaggtctgcttggtggagagctgagttcaagtcctggatatccttgttaagcttctgtctcattgatctgtctaatattgacagtggggtgttaaagtctcccatgatgattgtgtggagtctaaatctctttgtaggtctctcaggacttgctttatgaatctgggtgctcctgtatagggtgcatatatatttaggatagttaactcttcttgttgaattgatccctttaccattatgtagtggccttctttgtctcttttgatctttgttggtttaaagtctgttttatcagagactaggattgcaacacctgcctttttttgttttccatttgcttggtagatcttcctccatccctttattttgagcctatgtgtgtctctgcatgtgagatgggtttcctgagtacagcacactgatgggtcttgactctttatccaatttgccattctgtgttttttaactggggcatttagcccatttacatttaaggttaatattgttatgtgtgaatttgatcctgtcgttatgatgttagctggttatttcgcccgttagttgatgcagtttcttcctagcgtcaatggtctttacagtttggcatgtttttgcagtggctggtaccggttgttcctttccatgtttagtgcttcctttaggagctcttgtaaggcaggcctggtggtgacaaaatctctcagcatttgcttctctgtaaaggatttatttctccttcacttatgaagctttgtttggctggatatgaaattcttggttgaaaattcttttctttaagaatgttgaaggtgctggagaggatgtggagaaataggaacacttttacactgttggtgggactgtaaactagttcaacgattgtggaaggcagtgtggcaattcctcagggatctagaactagaaataccatttgacccagccatcccattactgggtgtatacccaaaggattataaatcatgctgctgtaaagacacatgcacacatatgtttattgcggcactattcacaatagcaaagacttggaaccaagccaaatatccagcaatgatagactggattaagaaaatgtggcacatatacaccatggaatactatgcagctataaaaaatgatgagttcatgtcctttgtaggggcatggatgaagctggaaaccatcattctcagcaaactattgcaaggacaaaaaaccaaataccgcatgttcttactcacaggtgggaattgaacaatgagaacacatggacacagaaaggggaacatcacacactggggcctgttgtagggtgtggggagggaggaggggtagcattaggagatatacctaatgttaaatgatgagttaatgggtgaagcacaccaatgtggacatgtatacatatgtaactaacctgcacgttgtgcacatgtaccctaagacttaaagtattaaaaaaaatatatatatatatacatacacacaaaaaataataaaggaaaactatacatatggaaaaaaaaaagaatgttgaatattgctcccactctcttctggcttgtagggtttgtgccaagagatctgctgctagtctgatgggtttccctttgtgggtaatccgacctttctctctggctgcccttagcattttttccttcatttcaaccttggtgaatctgacaattacgtgttttggggttgctcttctcgaggagtatctttatggtgttctctgtgtttcctgaatttgaatgttggccttccttgctaggttggggaagtcctcctggataatatcctgaagaatgtttcccagcttggttccattctccccatcactttcagtacaccaatcaaacgtagatttggtctttccacatagtcccatatttattggaggcttgttcatttctttttactcttttttctctaaacttctcttcttgcttcatttcactaatttgatcttgaatcactgataccatttcttgcacttgatcgaattggctactgaagcttgtgcatgcatcacgtagttctcgtgccatggttttcagctccatcaggtcatttaaggtcttctctacactgttcattctggttagccatttgtctaatcttttttcaaggtttttagcttccttgcgatgagttcgcacatcctcctttagctcagagaagtttgttattaccgactttctgaagcctacttctgtcagctcatcaaagtcattctccatcctgctttgttccattgctggcgaggagctgcgatcctttggaggagaagggatgtcaggtttttggaattttcagcttttgtgctctggtttctccccacctttgtggttttatctacccttggtctttgatgatggcgacctacagatggggttttggggtagatgtcttttttgttgatgttgatgctattcctttctgtgtgttagttttccttctaacagtcaggtccctcagcttcaggtctgttggagtttgctggaagtccactccagaccctcaaacagggatttcttggtgttgcctattctctcccatgtgtttaaatccagggagaggtgtatatattctttcttcctatttgttggtagtatgttggctagtatttttgcaagaaaagaaattgaaaaagtaaatatattatatcaaaatattgggaaaatggggcccttaatacacaagatctgtgtctgcactgcgtcaagaactctcttcacttgaatgctgcatgtaaaattcaacccaatttatgcaaagtagttgaagccctgtgtcagttctctgtgctgcaagtcatgatggtagtttacagggagagtccgggtgccctgagttggctcatctgtggcaaatgtactgagcacatgctgcccatttttgctctgtccccagagcagtcaccctccaccctgtatttagaaggatagttttatttctcttgaaggaaaaatgcctttggtttctgtgaccactccattctgtctcccatcagatcatctgggaggttttgttgtctaatgtctgttggttaaatcttctatcatccctgtcctgcctggctcatcaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagtgagtactccattgtgaaggtgataaagctccagttcatggcccaggtagaccccataatctttgggccttgtgccccttgttgggctgagatttgccatcaccgtgggctgaacctatatatcaatgtagacttcagtcactctggagtcaagtctgaagcacaggcatggggtgggtcagtgagctttactctcttcctagtctcaggccatgcccgtgccaacctggactgactgtcacgacattgaactcaaggcaggtgtggcaaactcacaccaaactatgtagcacatgcccaggagttgtctgtcagatcagctcatctgaattaaatgtctcttgccagctacaaaattccttatgagttttgttcccaaagcatgtctgtgtggttctttacctgcccaaggccagtgtcacccttgtctacctctcagtgaaagatgtgacccaggtttcactgaatttattcccattttctgtgtcttctaagttcgcttgttttagctcatctgtccgtcatgttcctggtatgttttctagataaatggctgacttttcacccacaaaagccataatagctgatgcttctgtgtagaaccaagtttcattttgactcaagagctggtacattgcaccccttcatcaaatctctgtgtccacaatctcataaactatcaaattctgggtatttgatgagagaaagcttaatattgaagtatctctcctatgaggtgttagaactatttgcctacaatttattggggaaaaaattgctcatttgtgtacataaacctaggacagagcacatagggaagataacattccaacacaggggaattttgcccaaggctcatgaaagaacccaagccagttttctcaagacttgacctcaggcctactggaatatttctctgaaagtctcctgttctcacactgacaagactgatgtccctgtgttaggattggacagaggaatgtttctgtgtgcaaggaagaacttaatgtaagagggcacatctgaatttatttgcaggacatcggtgggatcaagtgaaaaaggaggaccaagaggcaacaggtcccaggtgagtctgagaaattgtggacagttaatttgatgttgacacctggagatgccaagtccagggaaaacagtacatcctgaaaataatgattttgtcttgtcagacaagtctgaattatgcctactacattgctttttggttctcattagagtaaatgtttaggtttccatttcttcctacccttatcatttactaacctagtgaaagttgaccatacctcaaaagctgtattctcatggtaactgccgggaaacttgagcacattttatgcaaaattattgaggacatgcttttcatgatcactgttcactgtgtgtcctgagagcacaaatacagagtgtcctttgactccctcatcagtgtgtcacctgaccaattgactgagctcgctctgtgtgtgtgtgtgtgtgtgtgtgtgtgtgtgtgtgtgtgtgtgtgtgtgtctttctcgttcatccttttctacctggccctagtcaatcccaacataaaggcaataatttgttacctcattaatggatctgtcctttttcttttcaaactcttccttatgttagccatgaaatctagctggggctgtgtggtttctgattccccctggcttattctttactttttcctacttttccacgctcagcagggagctgctggatgagaaagggcctgaagtcttccaggactcacaggatagatgttattcaactccttcaggttgtcttgaactgactgactcatgccagccctacagaagtgccttttacatattggagcaacagcgtgttggcttggctattgacatggatggtgagtacctttctatgaaggtgataaggatccactgagtcttctggttagggtcatattcctactgcaagtggccgttactgagctgagagatgtcattgccacagggaggacctataggcacatgtaggttgaatgaaactctagttccacttggaagcccagacaagggatgggtcagtgagcaaggctctcttcctagtctcaggccatgcctgtggcaccataatcctactctcaagatgttggatctgggcagatatgacaaattcacacaactctgattttgtctaaattttgtagatcttgtagatttcatcctttactctaatttcagcgtctaaaatcctcgctaccatgaacaatctgagtatttgatgagacagggctgaatagtgcagtttttctcctagcaaccatttgggggcatttgctttaaatcgattggaaaaatatggcataaccatttgcacaaacttgggacaaatgatatttggataacgatctaccagaatagggaattttacccacagtttctgggacaaaaaccaaggaatctctgtggtgatcagccttcaggcctcctgaagaatatctctcacagtgtcctattctcatgctgaggagcctgaagtccctgtgtgaggattagacagtggattgttatgtgtgtaggagaacgagcttaatatgtctgtccatgtctgaacttattgcagaaattgaaaagtaccaagaagtggaagaagaccaagacccatcatgccccaggtaactttgagcaattatggatgcttaattctgtgttgacacctggagatgccaggtccagggaaaacaagagtgtgttcaatttcatgttttcaacgaaggttgaattactcctactgacattgctgttggttttcattgcagtagatgtttaggtttccatttcttcctccccttatcatttactcacttactataggttgaccatacctcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaactcgctgagctcactttctcctctctctctctctctctctctccctctccctgtctttctctttcattcttttctacctggccctggtctatcccaacataaaggcaataattcattacctcgttaatggatctgtcctttttctttttaaacagttccttatgttagccatgaaatctagctggggctgtgtggtttctgattccccctggcttattctttactttttcctacttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctgttcttccagataggggtgatattcctgttccaagtgccccttactgacccgagagacgtcattgccgcaggcaggacctatgggcgcatataggttgtaatgaaactgtagtctcagttggaagcctagacatgaaatgggtcagtgagcaaggctctattcctagtctccagccatgcctgtggcaacctgagcccgctctcagcacattggacccaggcagatgtaaaaaattcacagaagtatgatttggactgaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaagcataactgtttgcacaaacttgggataaatgattttgggataacgatctaccagaatggggatatttcacccttggttctgagatgcaaaccaaagaatatcatgaccagctttcaggcctcctgaagtatatctctcacattgtcctgttctcatgctgaggagcctgagatccctgtgtggggattagacagtggactgttatgggtgtaggtgaattggcttattttgtctgtccctgtctgaatgtattgcaggaattaaaaaggaccaagaagaggaagaagaccaaggcccaccatgccccaggtaactgagcaattgtgaacagctacttctgtgttgacatctggagactcctggttcagggaaaacagagcgggctgacattatcgattacatctcttcaaccaagcctgaattattcctactaacattgctgttggttttcattgcagtagatatttaggtttccatttcttcctccccttatcatttactaacctactgtaggtggaccagacttcaaaaactgtattctcatggtgactgcatggaaacttgagcacattttatggaaaattattgagcacagtcttttcatgatccctgtatgctgtgtgtcctgagggcactaactcagagtgtcctgttactccctcatcagtgcgtcacctggacaattcactgagctcgttctctctctctctgtgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccagacaagggatgggtcagtgagcaagactctcttcctagtctcaggccatacctgtggcgccctgatcctattctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcgtaactgtttgcacaaacttgggacaaatgatattgagataacgatctactagaatagggacactttacccacagtttctgggagaaaaaccgaggaatttctatcatgaccagccttcaggcctcctgaaatatatctctcacagtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctgtgttaacacctggaggcaacagattcagggaaaccagagtgtgtttgatgacatgttttcagcgaaggctgaattactcctactgtcattgctgttggttttcattgcagtagatgtttaggtttccatttcttcctccccttatcatttcctaacgtaccataggttgaccatacttcaaaagctgtactctcatggccactgcatcgaattttgagcatattttatggaaaactattgagctcactcttttcatgatcacagtttgctgtgtgtcatgagggcactaagtcagagtgtcctttgactcccttaccagtatgtcacctggccaattcactaggtcactttctctctgtctctgtctctgtctctgtctctctctctctgtctttctctttcattgttttctacctggccctgttctatcccaacataaaggcaataatttgttacctcattaatggatctgtcctttttcttttcaaactcttccttacgttagccatgaaatctagctggggctgtgtggtttctgattccccctggcttattctttactttttcccacttttccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttcgctgttgacatggatggtgagtacctttctatgaaggtgataaggatccactgagtcttctggttagggtcatattcctactgcaagtggcccttactgagctgagagatgtcattgccacagggaggacctataggcacatgtaggttgaatgaaactctagttccacttggaagcccagacaagggatgggtcagtgagcaaggctctcttcctagtctcaggccatgcctgtggcgccctaatcctactctcatgacattggacctgggcagatgtgacaaattcacacaactctgattttgtctcaattttgtagatcttgtagatttcatccttcactctaatttcagcgtctgaaatcctcgctaccatgaacaatctgagtatttgatgagacagggctgaatagtgcagtttttctcctagcaaccatttgggggcaatttctttaaatcgattggaaaaatatggcataaccatttgcacaaacttgggacaaatgatattgggataacgatctaccagaatagggaattttacccacagtttctgggacaaaaaccaaggaatctctatggtgatcagccttcatgcctcctgaagaatatctctcacagtgtcctattctcatgctgaggagcctgaagtccctgtgtgaggattagacagtggattgttatgtgtgtttaggagaaccagcttaatatgtctgtccatgtctgaacttattgcagaaattgaaaagtaccaagaagtggaagaagaccaagacccatcatgccccaggtaactatgagcaattatggatgcttaattctgtgttgacacctggagatgccaggtccagggaaaacaagagtgtgttcaatttcatgttttcaacgaaggttgaattactcctactgacattgctgttggttttcattgcagtagatgtttaggtttccatttcttcctccccttatcatttactcacttactataggttgaccatacctcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaattcgctgagctcactttctcctctctctctctctccctctccctgtctttctctttcattcttttctacctggccctggtctatcccaacataaaggcaataattcattacctcattaacggatctgtcctttttctttttaaacagttccttatgttagccatgaaatctagctggggctgtgtggtttctgattccccctggcttattctttactttttcctacttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctgttcttccagataggggtgatattcctgttccaagtgccccttactgacccgagagacgtcattgccgcaggcaggacctatgggcgcatataggttgtaatgaaactgtagtctcagttggaagcctagacatgaaatgggtcagtgagcaaggctctattcctagtctccagccatgcctgtggcaacctgagcccgctctcagcacgttggacccaggcagatgtaaaaaattcacagaagtatgatttggactgaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaagcataactgtttgcacaaacttgggataaatgattttgggataacgatctaccagaatggggatatttcacccttggttctgagatgcaaaccaaagaatatcatgaccagctttcaggcctcctgaagtatatctctcacattgtcctgttctcatgctgaggagcctgagatccctgtgtggggattagacagtggactgttatgggtgtaggtgaattggcttattttgtctgtccctgtctgaatgtattgcaggaattaaaaaggaccaagaagaggaagaagaccaaggcccaccatgccccaggtaactgagcaattgtgaacagctacttctgtgttgacatctggagactcctggttcagggaaaacagagcgggctgacattatcgattacatctcttcaaccaagcctgaattattcctactaacattgctgttggttttcattgcagtagatatttaggtttccatttcttcctccccttatcatttactaacctactgtaggtggaccagacttcaaaaactgtattctcatggtgactgcatggaaacttgagcacattttatggaaaattattgagcacagtcttttcatgatccctgtatgctgtgtgtcctgagggcactaactcagagtgtcctgttactccctcatcagtgcgtcacctggacaattcactgagctcgttctctctctctctgtgtgtgtgtgtgtgtgtgtgtgtgtgtgtgtgtgtgtgtgtctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccagacaagggatgggtcagtgagcaagactctcttcctagtctcaggccatacctgtggcgccctgatcctattctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcgtaactgtttgcacaaacttgggacaaatgatattgagataacgatctactagaatagggacactttacccacagtttctgggagaaaaaccgaggaatttctatcatgaccagccttcaggcctcctgaaatatatctctcacagtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctgtgttaacacctggaggcaacagattcagggaaaccagtgtgtttgatgacatgttttcagcgaaggctgaattactcctactgtcattgctgttggttttcattgcagtagatgtttaggtttccatttcttcctccccttatcatttcctaacgtaccataggttgaccatacttcaaaagctgtactctcatggccactgcatcgaattttgagcgtattttatggaaaactattgagctcactcttttcatgatcacagtttgctgtgtgtcatgagggcactaagtcagagtgtcctttgactcccttaccagtatgtcacctggccaattcactaggtcactttctctctgtctctgtctctgtctctgtctctctctctctgtctttctctttcattgttttctacctggccctgttctatcccaacataaaggcaataatttgttacctcattaatggatctgtcctttttcttttcaaactcttccttacgttagccatgaaatctagctggggctgtgtggtttctgattccccctggcttattctttactttttcccacttttccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttcgctgttgacatggatggtgagtacctttctatgaaggtgataaggatccactgagtcttctggttagggtcatattcctactgcaagtggcccttactgagctgagagatgtcattgccacagggaggacctataggcacatgtaggttgaatgaaactctagttccacttggaagcccagacaagggatgggtcagtgagcaaggctctcttcctagtctcaggccatgcctgtggcgccctaatcctactctcatgacattggacctgggcagatgtgacaaattcacacaactctgattttgtctcaattttgtagatcttgtagatttcatccttcactctaatttcagcgtctgaaatcctcgctaccatgaacaatctgagtatttgatgagacagggctgaatagtgcagtttttctcctagcaaccatttgggggcaatttctttaaatcgattggaaaaatatggcataaccatttgcacaaacttgggacaaatgatattgggataacgatctaccagaatagggaattttacccacagtttctgggacaaaaaccaaggaatctctatggtgatcagccttcatgcctcctgaagaatatctctcacagtgtcctactctcatgctgaggagcctgaagtccctgtgtgaggattagacagtggattgttatgtgtgtttaggagaaccagcttaatatgtctgtccatgtctgaacttattgcagaaattgaaaagtaccaagaagtggaagaagaccaagacccatcatgccccaggtaactttgagcaattatggatgcttaattctgtgttgacacctggagatgccaggtccagggaaaacaagagtgtgttcaatttcatgttttcaacgaaggttgaattactcctactgacattgctgttggttttcattgcagtagatgtttaggtttccatttcttcctccccttatcatttactcacttactataggttgaccatacgtcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaattcgctgagctcactttctcctctctctctctctccctctccctgtctttctctttcattcttttctacctggccctggtctatcccaacataaaggcaataattcattacctcattaacggatctgtcctttttctttttaaacagttccttatgttagccatgaaatctagctggggctgtgtggtttctgattccccctggcttattctttactttttcctacttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagacgtcattgccgcaggcaggacctatgggcgcatataggttgtaatgaaactgtagtctcagttggaagcctagacatgaaatgggtcagtgagcaaggctctattcctagtctccagccatgcctgtggcaacctgagcccgctctcagcacattggacccaggcagatgtaaaaaattcacagaagtatgatttggactgaagggtttgtagatttcctccttcattctaatttcagtgtctaaaattcttgcatccatgaacgagctgggcatttgatgagacagggctgaatactttagttttcctcctggaaatcatctggggcattttctttgaactgatgggaacaataaagcataactgtttgcacaaacttgggataaatgattttgggataacgatgtaccagaatggggatatttcacccttggttctgagatgcaaaccaaagaatatcatgaccagctttcaggcctcctgaagtatatctctcacattgtcctgttctcatgctgaggagcctgagatccctgtgtggggattagacagtggactgttatgggtgtaggtgaattggcttattttgtctgtccctgtctgaatgtattgcaggaattaaaaaggacgaagaagaggaagaagaccaagacccaccatgccccaggtaactgagcaattgtgaacagctacttctgtgttgacatctggagactccaggttcagggaaaacagagcgggctgacattatcgattacatcttttcaaccaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgcgtcacctggacaattcactgagctcgttctctctctctctgtgtgtgtgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagcgcctgaagtcttgcaggactcactggatagatgttattcaactccttccagttgtcttgaacagcctgactcctgccagccctatggaagttccttttatgcattggaggaaaaacatgttggcttttctcttgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccagacaagggatgggtcagtgagcaagactctcttcctagtctcaggccatacctgtggcgccctgatcctattctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcgtaactgtttgcacaaacttgggacaaatgatattgggataacgatctactagaatagggacattttacccacagtttctgggagaaaaaccgaggaatttctatcatgaccagccttcaggcctcctgaaatatatctctcacagtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctgtgttaacacctggaggcaacagattcagggaaaccagagtgtgtttgatgacatgttttcagcgaaggctgaattactcctactgtcattgctgttggttttcattgcagtagatgtttaggtttccatttcttcctccccttatcatttcctaacgtaccataggttgaccatacttcaaaagctgtactctcatggccactgcatcgaattttgagcatattttatggaaaactattgagctcactcttttcatgatcacagtttgctgtgtgtcatgagggcactaagtcagagtgtcctttgactcccttaccagtatgtcacctggccaattcactaggtcactttctctctgtctctgtctctgtctctgtctctgtctgtctttctctttcattgttttctacctggccctgttctgtcccaacataaaggcaataatttgttacctcattaatggatctgtcctttttcttttcaaactcttccttacgttagccatgaaatctagctggggctatgtggtttctgattccccctggcttattctttactttttcccacttttccaggctcagcagggagctgctggatgagaaagggcctgaagtcttgcaagactcactggatagatgttattcaactccttcaggttgtcttgaactgactgactcatgccagccctacagaagtgccttttatgtattggagcaacagcgtgttggcatggctgttgacatggatggtgagtacctttctatgaaggtgataaggatccactgagtcttctggttagggtcatattcctactgcaagtggcccttactgagctgagagatgtcattgccacagggaggacctataggcacatgtaggttgaatgaaactctagttccacttggaagcccagacaagggatgggtcagtgagcaaggctctcttcctagtctcaggccatgcctgtggcgccctaatcctactctcatgacattggacctgggcagatgtgacaaattcacacaactctgattttgtctcaattttgtagatcttgtagatttcatccttcactctaatttcagcgtctgaaatcctcgctaccatgaacaatctgagtatttgatgagacagggctgaatagtgcagtttttctcctagcaaccatttgggggcaattcctttaaatcgattggaaaaatatggcataaccatttgcacaaacttgggacaaatgatattgggataacgatctaccagaatagggaattttacccacagtttctgggacaaaaaccaaggaatctctatggtgatcagccttcatgcctcctgaagaatatctctcacagtgtcctattctcatgctgaggagcctgaagtccctgtgtgaggattagacagtggattgttatgtgtgtttaggagaaccagcttaatatgtctgtccatgtctgaacttattgcagaaattgaaaagtaccaagaagtggaagaagaccaagacccatcatgccccaggtaactatgagcaattatggatgcttaattctgtgttgacacctggagatgccaggtccagggaaaacaagagtgtgttcaatttcatgttttcaacgaaggttgaattactcctactgacattgctgttggttttcattgcagtagatgtttaggtttccatttcttcctccccttatcatttactcacttactataggttgaccatacgtcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaattcgctgagctcactttctcctctctctctctctccctctccctgtctttctctttcattcttttctacctggccctggtctatcccaacataaaggcaataattcattacctcattaacggatctgtccttttttttttaaacagttccttatgttagccatgaaatctagctggggctgtgtggtttctgattccccctggcttattctttactttttcctacttttccaggctcagcagggagctgctggatgagaaagagcctgaagtcttgcaggactcactgaatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtgccccttactgacccgagagacgtcattgccgcaggcaggacctatgggcgcatataggttgtaatgaatctgtagtctcagttggaagcctagacatgaaatgggtcagtgagcaaggctctattcctagtctccagccatgcctgtggcaacctgagcccgctctcagcacattggacccaggcagatgtaaaaaattcacagaagtatgatttggactgaagggtttgtagatttcctccttcattctaatttcagtgtctaaaattcttgcatccatgaacgagctgggcatttgatgagacagggctgaatactttagttttcctcctggaaatcatctggggcattttctttgaactgatgggaacaagaaagcataactgtttgcacaaacttgggataaatgattttgggataacgatctaccagaatggggatatttcacccttggttctgatatgcaaaccaaggaatatcatgaccagctttcaggcctcctgaagtatatctctcacattgtcctgttctcatgctgaggagtctgagatccctgtgtggggattagacagtggactgttatgggtgtaggtgaattggcttattttgtctgtccctgtctgaatgtattgcaggaattaaaaaggaccaagaagaggaagaagacgaagaccaagacccaccatgccccaggtaactgagcaattgtgaacagctacttctgtgttgacatctggagactccaggttcagggaaaacagagcgggctgacattatcgattacatcttttcaaccaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgcgtcacctggacaatttactgagctcgttctctctctctctgtgtgtgtgtgtgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaccatgttggcttttctcttgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccagacaagggatgggtcagtgagcaagactctcttcctagtctcaggccatacctgtggcgccctgatcctattctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcgtaactgtttgcacaaacttgggacaaatgatattgagataacgatctactagaatagggacattttacccacagtttctgggagaaaaaccgaggaatttctatcatgaccagccttcaggcctcctgaaatatatctctcacagtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctgtgttaacacctggaagcaacagattcagggaaaccagagtgtgtttgatgacatgttttcagcgaaggctgaattactcctactgtcattgctgttggttttcattgcagtagatgtttaggtttccatttcttcctccccttatcatttcctaacgtaccataggttgaccatacttcaaaagctgtactctcatggccactgcatcgaattttgagcatattttatggaaaactattgagctcactcttttcatgatcacagtttgctgtgtgtcatgagggcactaactcagagtgtcctttgactcccttaccagtatgtcacctggccaattcactaggtcactttctctctgtctctgtctctgtctctgtctctgtctgtctttctctttcattgttttctacctggccctgttctgtcccatcataaaggcaataatttgttacctcattaatggatctgtcctttttcttttcaaactcttccttacgttagccatgaaatctaggtggggctgtgtggtttctgattccccctggcttattctttactttttcccacttttccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatggtgagtacctttctatgaaggtgataaggatccactgagtcttctggttagggtcatattcctactgcaagtggcccttactgagctgagagatgtcattgccacagggaggaactataggcacatgtaggttgagtgaaactctagttccactttgaagcccagacaagggatgggtcagtgagcaaggctctcttcctagtctcaggccatgcccgtggcgccctaatcctactctcaagatgttggatctgggcagatgtgacaaattcacacaactctgattttgtctcaattttgtagatcttggagatttcatccttcactctaatttcagcgtctaaaatcctcactaccatgaacaatctgagtatttgatgagacagggctgaatagtgcagtttttctcctagcagccatttgggggcatttgctttaaatcgattggaaaaatatggcataaccatttgcacaaacttgggacaaatgatattgggataacgatctaccagaatagggaattttacccacagtttctgggacaaaaaccaaggaatctctatggtgatcagccttcaggcctcctgaagactatctctcacagtgtcctattctcatgctgaggagcctgaagtccctgtgtgaggattagacagtggattgttatgtgtgtaggagaaccagcttaatatgtctgtccatgtctgaacttattgcagaaattgaaaagtaccaagaagtggaagaagaccaagacccatcatgccccaggtaactttgagcaattatggatgcttaattctgtgttgacacctggagatgccaggtccagggaaaacaagagtgtgttcaatttcatgttttcaacgaaggttgaattactcctactgacattgctgttggttttcattgcagtagatgtttaggtttccatttcttcctccccttatcatttactcacttactataggttgaccatacgtcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaattcgctgagctcactttctcctctctctctctctccctctccctgtctttctctttcattcttttctacctggccctggtctatcccaacataaaggcaataattcattacctcattaatggatctgtcctttttctttttaaacagttccttatgttagccatgaaatctagctggggctgtgtggtttctgattccccctgacttattctttactttttcctacttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacgtggtcttccagataggggtgatattcctgttccaagtgccccttactgacccgagagacgtcattgccgcaggcaggacctatgggcgcatataggttgtaatgaaactgtagtctcagttggaagcctagacatgaaatgggtcagtgagcaaggctctattcctagtctccagccatgcctgtggcaacctgagcccgctctcagcacattggacccaggcagatgtaaaaaattcacagaagtatgatttggactcaagggtttgtagatttcctccttcattctaatttcagtgtctaaaattcttgcatccatgaacgagctgggcatttgatgagacagggctgaatactttagttttcctcctggaaatcatctgggacattttctttgaactgatgggaacaataaagcataactgtttgcacaaacttgggataaatgattttgggataacgatgtaccagaatggggatatttcacccttggttctgagatgtaaaccaaagaatatcatgaccagctttcaggcctcctgaagtatatctctcacattgtcctgttctcatgctgaggagcctgagatccctgtgtggggattagacagtggactgttatgggtgtaggtgaattggcttattttgtctgtccctgtctgaatgtattgcaggaattaaaaaggaccaagaagaggaagaagaccaaggcccaccatgccccaggtaactgagcaattgtgaacagctacttctgtgttgacatctggagactcctggttcagggaaaacagtgcgggctgacattatcgattacatcttttcaaccaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctctctctctctgtgtgtgtttgtgtgtttgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaccatgttggcttttctcttgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccagacaagggatgggtcagtgagcaagactctcttcctagtctcaggccatacctgtggcgccctgatcctattctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcgtaactgtttgcacaaacttgggacaaatgatattgggataacgatctactagaatagggacattttacccacagtttctgggagaaaaaccgaggaatttctatcatgaccagccttcaggcctcctgaaatatatctctcacagtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctgtgttaacacctggaggcaacagattcagggaaaccagagtgtgtttgatgacatgttttcagcgaaggctgaattactcctactgtcattgctgttggttttcattgcagtagatgtttaggtttccatttcttcctccccttatcatttcctaacgtaccataggttgaccatacttcaaaagctgtactctcatggccactgcatcgaattttgagcatattttatggaaaactattgagctcactcttttcatgatcacagtttgctgtgtgtcatgagggcactaactcagagtgtcctttgactcccttaccagtatgtcacctggccaattcactaggtcactttctctctgtctctgtctctgtctgtctttctctttcattgttttctacctggccctgttctgtcccaacataaaggcaataatttgttacctcattaatggatctgtcctttttcttttcaaactcttccttacgttagccatgaaatctagctggggctgtgtggtttctgattccccctggcttattctttactttttcccacttttccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatggtgagtacctttctatgaaggtgataaggatccactgagtcttctggttagggtcatattcctactgcaagtggcccttactgagctgagagatgtcattgccacagggaggaactataggcacatgtaggttgagtgaaactctagttccacttggaagcccagacaagggatgggtcagtgagcaaggctctcttcctagtctcaggccatgcccgtggcgccctaatcctactctcaagatgttggatctgggcagatgtgacaaattcacacaactctgattttgtctcaattttgtagatcttggagatttcatccttcactctaatttcagcgtctaaaatcctcactaccatgaacaatctgagtatttgatgtgacagggctgaatagtgcagtttttctcctagcagccatttgggggcatttgctttaaatcgattggaaaaatatggcataaccatttgcacaaacttgggacaaatgatattgggataatgatctaccagaatagggaattttacccacagtttctgggacaaaaaccaaggaatctctatggtgatcagccttcaggcctcctgaagactatctctcacagtgtcctattctcatgctgaggagcctgaagtccctgtgtgaggattagacagtggattgttatgtgtgtaggagaaccagcttaatatgtctgtccatgtctgaacttattgcagaaattgaaaagtaccaagaagtggaagaagaccaagacccatcatgccccaggtaactttgagcaattatggatgcttaattctgtgttgacacctggagatgccaggtccagggaaaacaagagtgtgttcaatttcatattttcaacgaaggttgaattactcctactgacattgctgttggttttcattgcagtagatgtttaggtttccatttcttcctccccttatcatttactcacttactataggttgaccatacctcaaaggctgtatggcaactgcatggaatcttgagcaaggttatggaaaattattgagcccactcttttcatgatcactgttcgctgtgtgtcccgagggcactaactcagagtgtcctttgaccccttcatcaatgtgtcacccggccaattcgctgagctcactttctcctctctctctttctccctctccctgtctttctctttcattcttttctacctggccctggtctatcccaacataaaggcaataattcattacctcattaatggatctgtcctttttctttttaaacagttccttatgttagccatgaaatctagctggggctgtgtggtttctgattccccctgacttattctttactttttcctacttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtgccccttactgacccgagagacgtcattgccgcaggcaggacctatgggcgcatataggttgtaatgaaactgtagtctcagttggaagcctagacatgaaatgggtcagtgagcaaggctctattcctagtctccagccatgcctgtggcaacctgagcccgctctcagcacattggacccaggcagatgtaaaaaattcacagaagtatgatttggactgaagggtttgtagatttcctccttcattctaatttcagtgtctaaaattcttgcatccatgaacgagctgggcatttgatgagacagggctgaatactttagttttcctcctggaaatcatctggggcattttctttgaactgatgggaacaataaagcataactgtttgcacaaacttgggataaatgattttgggataacgatgtaccagaatggggatatttcacccttggttctgagatgtaaaccaaagaatatcatgaccagctttcaggcctcctgaagtatatctctcacattgtcctgttctcatgctgaggagcctgagatccctgtgtggggattagacagtggactgttatgggtgtaggtgaattggcttattttgtctgtccctgtctgaatgtattgcaggaattaaaaaggaccaagaagaggaagaagaccaaggcccaccatgccccaggtaactgagcaattgtgaacagctacttctgtgttgacatctggagactcctggttcagggaaaacagtgcgggctgacattatcgattacatcttttcaaccaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctctctctctctgtgtgtgtgtgtgtgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaccatgttggcttttctcttgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccagacaagggatgggtcagtgagcaagactctcttcctagtctcaggccatacctgtggcgccctgatcctattctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcgtaactgtttgcacaaacttgggacaaatgatattgggataacgatctactagaatagggacattttacccacagtttctgggagaaaaaccgaggaatttctatcatgaccagccttcaggcctcctgaaatatatctctcacagtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctgtgttaacacctggaggcaacagattcagggaaaccagagtgtgtttgatgacatgttttcagcgaaggctgaattactcctactgtcattgctgttggttttcattgcagtagatgtttaggtttccatttcttcctccccttatcatttcctaacgtaccataggttgaccatacttcaaaagctgtactctcatggccactgcatcgaattttgagcatattttatggaaaactattgagctcactcttttcatgatcacagtttgctgtgtgtcatgagggcactaactcagagtgtcctttgactcccttaccagtatgtcacctggccaattcactaggtcactttctctctgtctctgtctctgtctgtctttctctttcattgttttctacctggccctgttctgtcccaacataaaggcaataatttgttacctcattaatggatctgtcctttttcttttcaaactcttccttacgttagccatgaaatctagctggggctgtgtggtttctgattccccctggcttattctttactttttcccacttttccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatggtgagtacctttctatgaaggtgataaggatccactgagtcttctggttagggtcatattcctactgcaagtggcccttactgagctgagagatgtcattgccacagggaggaactataggcacatgtaggttgagtgaaactctagttccacttggaagcccagacaagggatgggtcagtgagcaaggctctcttcctagtctcaggccatgcccgtggcgccctaatcctactctcaagatgttggatctgggcagatgtgacaaattcacacaactctgattttgtctcaattttgtagatcttggagatttcatccttcactctaatttcagcgtctaaaatcctcactaccatgaacaatctgagtatttgatgtgacagggctgaatagtgcagtttttctcctagcagccatttgggggcatttgctttaaatcgattggaaaaatatggcataaccatttgcacaaacttgggacaaatgatattgggataacgatctaccagaatagggaattttacccacagtttctgggacaaaaaccaaggaatctctatggtgatcagccttcaggcctcctgaagactatctctcacagtgtcctattctcatgctgaggagcctgaagtccctgtgtgaggattagacagtggattgttatgtgtgtaggagaaccagcttaatatgtctgtccatgtctgaacttattgcagaaattgaaaagtaccaagaagtggaagaagaccaagacccatcatgccccaggtaactttgagcaattatggatgcttaattctgtgttgacacctggagatgccaggtccagggaaaacaagagtgtgttcaatttcatattttcaacgaaggttgaattactcctactgacattgctgttggttttcattgcagtagatgtttaggtttccatttcttcctccccttatcatttactcacttactataggttgaccatacctcaaaggctgtatggcaactgcatggaatcttgagcaaggttatggaaaattattgagcccactcttttcatgatcactgttcgctgtgtgtcccgagggcactaactcagagtgtcctttgaccccttcatcaatgtgtcacccggccaattcgctgagctcactttctcctctctctctctctccctctccctgtctttctctttcattcttttctacctggccctggtctatcccaacataaaggcaataattcattacctcattaatggatctgtcctttttctttttaaacagttccttatgttagccatgaaatctagctggggctgtgtggtttctgattccccctgacttattctttactttttcctacttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtgccccttactgacccgagagacgtcattgccgcaggcaggacctatgggcgcatataggttgtaatgaaactgtagtctcagttggaagcctagacatgaaatgggtcagtgagcaaggctctattcctagtctccagccatgcctgtggcaacctgagcccgctctcagcacattggacccaggcagatgtaaaaaattcacagaagtatgatttggactgaagggtttgtagatttcctccttcattctaatttcagtgtctaaaattcttgcatccatgaacgagctgggcatttgatgagacagggctgaatactttagttttcctcctggaaatcatctggggcattttctttgaactgatgggaacaataaagcataactgtttgcacaaacttgggataaatgattttgggataacgatgtaccagaatggggatatttcacccttggttctgagatgtaaaccaaagaatatcatgaccagctttcaggcctcctgaagtatatctctcacattgtcctgttctcatgctgaggagcctgagatccctgtgtggggattagacagtggactgttatgggtgtaggtgaattggcttattttgtctgtccctgtctgaatgtattgcaggaattaaaaaggaccaagaagaggaagaagaccaaggcccaccatgccccaggtaactgagcaattgtgaacagctacttctgtgttgacatctggagactcctggttcagggaaaacagtgcgggctgacattatcgattacatcttttcaaccaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctctctctctctctgtgtgtgtgtgtgtgtgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaccatgttggcttttctcttgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccagacaagggatgggtcagtgagcaagactctcttcctagtctcaggccatacctgtggcgccctgatcctattctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcgtaactgtttgcacaaacttgggacaaatgatattgggataacgatctactagaatagggacattttacccacagtttctgggagaaaaaccgaggaatttctatcatgaccagccttcaggcctcctgaaatatatctctcacagtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctgtgttaacacctggaggcaacagattcagggaaaccagagtgtgtttgatgacatgttttcagcgaaggctgaattactcctactgtcattgctgttggttttcattgcagtagatgtttaggtttccatttcttcctccccttatcatttcctaacgtaccataggttgaccatacttcaaaagctgtactctcatggccactgcatcgaattttgagcatattttatggaaaactattgagctcactcttttcatgatcacagtttgctgtgtgtcatgagggcactaactcagagtgtcctttgactcccttaccagtatgtcacctggccaattcactaggtcactttctctctgtctctgtctctgtctgtctttctctttcattgttttctacctggccctgttctgtcccaacataaaggcaataatttgttacctcattaatggatctgtcctttttcttttcaaactcttccttacgttagccatgaaatctagctggggctgtgtggtttctgattccccctggcttattctttactttttcccacttttccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatggtgagtacctttctatgaaggtgataaggatccactgagtcttctggttagggtcatattcctactgcaagtggcccttactgagctgagagatgtcattgccacagggaggaactataggcacatgtacgttgagtgaaactctagttccacttggaagcccagacaagggatgggtcagtgagcaaggctctcttcctagtctcaggccatgcccgtggcgccctaatcctactctcaagatgttggatctgggcagatgtgacaaattcacacaactctgattttgtctcaattttgtagatcttggagatttcatccttcactctaatttcagcgtctaaaatcctcactaccatgaacaatctgagtatttgatgtgacagggctgaatagtgcagtttttctcctagcagccatttgggggcatttgctttaaatcgattggaaaaatatggcataaccatttgcacaaacttgggacaaatgatattgggataacgatctaccagaatagggaattttacccacagtttctgggacaaaaaccaaggaatctctatggtgatcagccttcaggcctcctgaagactatctctcacagtgtcctattctcatgctgaggagcctgaagtccctgtgtgaggattagacagtggattgttatgtgtgtaggagaaccagcttaatatgtctgtccatgtctgaacttattgcagaaattgaaaagtaccaagaagtggaagaagaccaagacccatcatgccccaggtaactttgagcaattatggatgcttaattctgtgttgacacctggagatgccaggtccagggaaaacaagagtgtgttcaatttcatattttcaacgaaggttgaattactcctactgacattgctgttggttttcattgcagtagatgtttaggtttccatttcttcctccccttatcatttactcacttactataggttgaccatacctcaaaggctgtatggcaactgcatggaatcttgagcaaggttatggaaaattattgagcccactcttttcatgatcactgttcgctgtgtgtcccgagggcactaactcagagtgtcctttgaccccttcatcagtgtgtcacccggccaattcgctgagctcactttctcctctctctctttctccctctccctgtctttctctttcattcttttctacctggccctggtctatcccaacataaaggcaataattcattacctcattaatggatctgtcctttttctttttaaacagttccttatgttagccatgaaatctagctggggctgtgtggtttctgattccccctgacttattctttactttttcctacttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtgccccttactgacccgagagacgtcattgccgcaggcaggacctatgggcgcatataggttgtaatgaaactgtagtctcagttggaagcctagacatgaaatgggtcagtgagcaaggctctattcctagtctccagccatgcctgtggcaacctgagcccgctctcagcacattggacccaggcagatgtaaaaaattcacagaagtatgatttggactgaagggtttgtagatttcctccttcattctaatttcagtgtctaaaattcttgcatccatgaacgagctgggcatttgatgagacagggctgaatactttagttttcctcctggaaatcatctggggcattttctttgaactgatgggaacaataaagcataactgtttgcacaaacttgggataaatgattttgggataacgatgtaccagaatggggatatttcacccttggttctgagatgtaaaccaaagaatatcatgaccagctttcaggcctcctgaagtatatctctcacattgtcctgttctcatgctgaggagcctgagatccctgtgtggggattagacagtggactgttatgggtgtaggtgaattggcttattttgtctgtccctgtctgaatgtattgcaggaattaaaaaggaccaagaagaggaagaagaccaaggcccaccatgccccaggtaactgagcaattgtgaacagctacttctgtgttgacatctggagactcctggttcagggaaaacagtgcgggctgacattatcgattacatcttttcaaccaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctctctctctctgtgtgtgtgtgtgtgtgtgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaccatgttggcttttctcttgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccagacaagggatgggtcagtgagcaagactctcttcctagtctcaggccatacctgtggcgccctgatcctattctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcgtaactgtttgcacaaacttgggacaaatgatattgggataacgatctactagaatagggacattttacccacagtttctgggagaaaaaccgaggaatttctatcatgaccagccttcaggcctcctgaaatatatctctcacagtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctgtgttaacacctggaggcaacagattcagggaaaccagagtgtgtttgatgacatgttttcaacgaaggctgaattactcctactgtcattgctgttggttttcattgcagtagatgtttaggtttccatttcttcctccccttatcatttcctaacgtaccataggttgaccatacttcaaaagctgtactctcatggccactgcatcgaattttgagcgtattttatggaaaactattgagctcactcttttcatgatcacagtttgctgtgtgtcatgagggcactaactcagagtgtcctttgactcccttaccagtatgtcacctggccaattcactaggtcactttctctctgtctctgtctctgtctctgtctgtctttctctttcattgttttctacctggccctgttctgtcccaccataaaggcaataatttgttacctcattaatggatctgtcctttttcttttcaaactcttccttacgttagccatgaaatctagctggggctgtgtggtttctgattccccctggcttattctttactttttcccacttttccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatggtgagtacctttctatgaaggtgataaggatccactgagtcttctggttagggtcatattcctactgcaagtggcccttactgagctgagagatgtcattgccacagggaggaactataggcacatgtaggttgagtgaaactctagttccacttggaagcccagacaagggatgggtcagtgagcaaggctctcttcctagtctcaggccatgcccgtggcgccctaatcctactctcaagatgttggatctgggcagatgtgacaaattcacacaactctgattttgtctcaattttgtagatcttggagatttcatccttcactctaatttcagcgtctaaaatcctcactaccatgaacaatctgagtatttgatgagacagggctgaatagtgcagtttttctcctagcagccatttgggggcatttgctttaaatcgattggaaaaatatggcataaccatttgcacaaacttgggacaaatgatattgggataacgatctaccagaatagggaattttacccacagtttctgggacaaaaaccaaggaatctctatggtgatcagccttcaggcctcctgaagactatctctcacagtgtcctattctcatgctgaggagcctgaagtccctgtgtgaggattagacagtggattgttatgtgtgtaggagaaccagcttaatatgtctgtccatgtctgaacttattgcagaaattgaaaagtaccaagaagtggaagaagaccaagacccatcatgccccaggtaactttgagcaattatggatgcttaattctgtgttgacacctggagatgccaggtccagggaaaacaagagtgtgttcaatttcatgttttcaacgaaggttgaattactcctactgacattgctgttggttttcattgcagtagatgtttaggtttccatttcttcctccccttatcatttactcacttactataggttgaccatacctcaaaggctgtatggcaactgaatggaatcttgagcaagtttatggaaaattattgagcccactcttttcatgatcactgttcgctgtgtgtcccgagggcactaactcagagtgtcctttgaccccttcatcagtgtgtcacccggccaattcgctgagctcactttctcctctctctctctctccctctccctgtctttctctttcattcttttctacctggccctggtctatcccaacataaaggcaataattcattacctcattaatggatctgtcctttttctttttaaacagttccttatgttagccatgaaatctagctggggctgtgtggtttctgattccccctgacttattctttactttttcctacttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacgtggtcttccagataggggtgatattcctgttccaagtgccccttactgacccgagagacgtcattgccgcaggcaggacctatgggcgcatataggttgtaatgaaactgtagtctcagttggaagcctagacatgaaatgggtcagtgagcaaggctctattcctagtctccagccatgcctgtggcaacctgagcccgctctcagcacattggacccaggcagatgtaaaaaattcacagaagtatgatttggactgaagggtttgtagatttcctccttcattctaatttcagtgtctaaaattcttgcatccatgaacgagctgggcatttgatgagacagggctgaatactttagttttcctcctggaaatcatctggggcattttctttgaactgatgggaacaataaagcataactgtttgcacaaacttgggataaatgattttgggataacgatgtaccagaatggggatatttcacccttggttctgagatgtaaaccaaagaatatcatgaccagctttcaggcctcctgaagtatatctctcacattgtcctgttctcatgctgaggagcctgagatccctgtgtggggattagacagtggactgttatgggtgtaggtgaattggcttattttgtctgtccctgtctgaatgtattgcaggaattaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttcaaccaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctctctctctgtgtgtgtgtgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccagacaagggatgggtcagtgagcaagactctcttcctagtctcaggccatacctgtggcgccctgatcctattctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcgtaactgtttgcacaaacttgggacaaatgatattgggataacgatctactagaatagggacattttacccacagtttctgggagaaaaaccgaggaatttctatcatgaccagccttcaggcctcctgaaatatatctctcacagtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctgtgttaacacctggaggcaacagattcagggaaaccagagtgtgtttgatgacatgttttcagcgaaggctgaattactcctactgtcattgctgttggttttcattgcagtagatgtttaggtttccatttcttcctccccttatcatttcctaacgtaccataggttgaccatacttcaaaagctgtactctcatggccactgcatcgaattttgagcatattttatggaaaactattgagctcactcttttcatgatcacagtttgctgtgtgtcatgagggcactaactcagagtgtcctttgactcccttaccagtatgtcacctggccaattcactaggtcactttctctctgtctctgtctctgtctctgtctctgtctctgtctgtctttctctttcattgttttctacctggccctgttctatcccaacataaaggcaataatttgttacctcattaatggatctgtcctttttcttttcaaactcttccttacgttagccatgaaatctagctggggctgtgtggtttctgattccccctggcttattctttactttttcccacttttccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatggtgagtacctttctatgaaggtgataaggatccactgagtcttctggttagggtcatattcctactgcaagtggcccttactgagctgagagatgtcattgccacagggaggaactataggcacatgtacgttgagtgaaactctagttccacttggaagcccagacaagggatgggtcagtgagcaaggctctcttcctagtctcaggccatgcccgtggcgccctaatcctactctcaagatgttggatctgggcagatgtgacaaattcacacaactctgattttgtctcaattttgtagatcttggagatttcatccttcactctaatttcagcgtctcaaatcctcactaccatgaacaatctgagtatttgatgagacagggctgaatagtgcagtttttctcctagcaaccatttgggggcatttgctttaaatcgattggaaaaatatggcataaccatttgcacaaacttgggacaaatgatattgggataacgatctaccagaatagggaattttacccacagtttctgggacaaaaaccaaggaatctctatggtgatcagccttcaggcctcctgaagactatctctcacagtgtcctattctcatgctgaggagcctgaagtccctgtgtgaggattagacagtggattgttatgtgtgtaggagaaccagcttaatatgtctgtccatgtctgaacttattgcagaaattgaaaagtaccaagaagtggaagaagaccaagacccatcatgccccaggtaactttgagcaattatggatgcttaattctgtgttgacacctggagatgccaggtccagggaaaacaagagtgtgttaaatttcatgttttcaacgaaggttgaattactcctactgacattgctgttggttttcattgcagtagatgtttaggtttccatttcttcctcccctcatcatttgctcacttactataggttgaccatacctcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaattcgctgagctcactttctcctccctctctctctctccctctccctgtctttctctttcattcttttctacctggccctggtctatcccaacataaaggcaataattcattacctcattaatggatctgtcctttttctttttaaacagttccttatgttagccatgaaatctagctggggctgtgtggtttctgattccccctgacttattctttactttttcctacttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtgccccttactgacccgagagacgtcattgccgcaggcaggacctatgggcgcatataggttgtaatgaaactgtattctcagttggaagcctagacatgaaatgggtcagtgagcaaggctctattcctagtctccagccatgcctgtggcaacctgagcccgctctcagcacattggacccaggcagatgtaaaaaattcacagaagtatgatttggactcaagggtttgtagatttcctccttcattctaatttcagtgtctaaaattcttgcatccatgaacgagctgggcatttgatgagacagggctgaatactttagttttcctcctggaaatcatctggggcattttctttgaactgatgggaacaataaagcataactgtttgcacaaacttgggataaatgattttgggataacgatctaccagaatggggatatttcacccttggttctgagatgtaaaccaaagaatatcatgagcagctttcaggcctcctgaagtatatctctcacattgtcctgttctcatgctgaggagcctgagatccctgtgtggggattagacagtggactgttatgggtgtaggtgaattggcttattttgtctgtccctgtctgaatgtattgcaggaattaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttcaaccaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctctctctctctgtgtgtgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccagacaagggatgggtcagtgagcaagactctcttcctagtctcaggccatacctgtggcgccctgatcctattctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcgtaactgtttgcacaaacttgggacaaatgatattgggataacgatctactagaatagggacattttacccacagtttctgggagaaaaaccgaggaatttctatcatgaccagccttcaggcctcctgaaatatatctctcacagtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctgtgttaacacctggaggcaacagattcagggaaaccagagtgtgtttgatgacatgttttcaacgaaggctgaattactcctactgtcattgctgttggttttcattgcagtagatgtttaggtttccatttcttcctccccttatcatttcctaacgtaccataggttgaccatacttcaaaagctgtactctcatggccactgcatcgaattttgagcgtattttatggaaaactattgagctcactcttttcatgatcacagtttgctgtgtgtcatgagggcactaactcagagtgtcctttgactcccttaccagtatgtcacctggccaattcactaggtcactttctctctgtctctgtctctgtctctgtctgtctttctctttcattgttttctacctggccctgttctgtcccaccataaaggcaataatttgttacctcattaatggatctgtcctttttcttttcaaactcttccttacgttagccatgaaatctagctggggctgtgtggtttctgattccccctggcttattctttactttttcccacttttccaggctcagcagggagctgctggatgagaaagggcctaaagtcttgcaggactcactggatagatgttattcaactccttcaggttgtcttgaactgtgtgactcatgccagccctacagaagtgccttttatgtattggagcaacagcgtgttggcttggctgttgacatggatggtgagtacctttctatgaaggtgataaggatccactgagtcttctggttagggtcatattcctactgcaagtggcccttactgagctgagagatgtcattgccacagggaggacctataggcatatgtaggttgaatgaaactctagttccacttggaagcccagaaaagggatgggtcagtgagcaaggctctcttcctagtctcaggccatgcctgtggcgccctaatcctactttcaagatgttggatctgggcagatgtgacaaattcacacaactctgattttgtctcaattttgtagatcttgtagatttcatccttcactctaatttcagcgtctacaatcctcgctaccatgaacaatctgagtatttgatgagacagggctgaatagtgcagtttttctcctagcagccatttgggggcatttgctttaaatcgattggaaaaatatggcataaccatttgcacaaacttgggacaaatgatattgggataacgatctaccagaatagggaattttacccacagtttctgggacaaaaaccaaggaatctctatggtgatcagccttcaggcctcctgaagactatctctcacagtgtcctattctcatgctgaggagcctgaagtccctgtgtgaggattagacagtggattgttatgtgtgtaggagaaccagcttaatatgtctgtccatgtctgaacttattgcagaaattgaaaagtaccaagaagtggaagaagaccaagacccatcatgccccaggtaactttgagcaattatggatgcttaattctgtgttgacacctggagatgccaggtccagggaaaacaagagtgtgttcaatttcatgttttcagcgaaggttgaattactcctactgacattgctgttggttttcattgcagtagatgtttaggtttccatttcttcctccccttatcatttactcacttactataggttgaccatacgtcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaattcgctgagctcactttctcctctctctctctctccctctccctgtctttctctttcattcttttctacctggccctggtctatcccaacataaaggcaataattcattacctcattaacggatctgtcctttttctttttaaacagttccttatgttagccatgaaatctagctggggctgtgtggtttctgattccccctggcttattctttactttttcctacttttccaggctcagcagggagctgctggatgagaaagggcctgaagtcttgcaggactcactggatagatgttattcgactccttcaggttgtcttgaactgtgtgactcatgccagccctacagaagtgccttttacatattggagcaacagcgtgttggcttggctgttgacatggatggtgagtacctttctatgaaggtgataaggatccactgagtcttctggttagggtcatattcctactgcaagtggcccttactgagctgagagatgtcattgccacagggaggacctataggcacatgtaggttgaatgaaactctagttccacttggaagcccagacaagggatgggtcagtgagcaaggctctcttcctagtctcaggccatgcctgtggcgccctaatcctactctcaagatgttggatctgggcagatgtgacaaattcacacaactctgattttgtctcaattttgtagatcttgtagatttcatccttcactctaatttcagcgtctgaaatcctcgctaccatgaacaatctgagtatttgatgagacagggctgaatagtgcagtttttctcctagcaaccatttgggggcaattgctttaaatcgattggaaaaatatggcataaccatttgcacaaacttgggacaaatgatattgggataatgatctaccagaatagggaattttacccacagtttctgggacaaaaaccaaggaatctctatggtgatcagccttcaggcctcctgaggaatatctctcacagtgtcctattctcatgctgaggagcctgaagtccctgtgtgaggattagacagtggattgttatgtgtgtttaggagaaccagcttaatatgtctgtccatgtctgaacttattgcagaaattgaaaagtaccaagaagtggaagaagaccaagacccatcatgccccaggtaactttgagcaattatggatgcttaattctgtgttgacacctggagatgccaggtccagggaaaacaagagtgtgttcaatttcatgttttcaacgaaggttgaattactcctactgacattgctgttggttttcattgcagtagatgtttaggtttccatttcttcctccccttatcatttactcacttactataggttgaccatacctcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaattcgctgagctcactttctcctctctctctctctccctctccctgtctttctctttcattcttttctacctggccctggtctatcccaacataaaggcaataattcattacctcattaatggatctgtcctttttctttttaaacagttccttatgttagccatgaaatctagctggggctgtgtggtttctgattccccctgacttattctttactttttcctacttttccaggcttagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacgtggtcttccagataggggtgatattcctgttccaagtgccccttactgacccgagagacgtcattgccgcaggcaggacctatgggcgcatataggttgtaatgaaactgtagtctcagttggaagcctagacatgaaatgggtcagtgagcaaggctctattcctagtctccagccatgcctgtggcaacctgagcccgctctcagcacattggacccaggcagatgtaaaaaattcacagaagtatgatttggactgaagggtttgtagatttcctccttcattctaatttcagtgtctaaaattcttgcatccatgaacgagctgggcatttgatgagacagggctgaatactttagttttcctcctggaaatcatctggggcattttctttgaactgatgggaacaataaagcataactgtttgcacaaacttgggataaatgattttgggataacgatgtaccagaatggggatatttcacccttggttctgagatgtaaaccaaagaatatcatgaccagctttcaggcctcctgaagtatatctctcacattgtcctgttctcatgctgaggagcctgagatccctgtgtggggattagacagtggactgttatgggtgtaggtgaattggcttattttgtctgtccctgtctgaatgtattgcaggaattaaaaaggaccaagaagaggaagaagaccaaggcccaccatgccccaggtaactgagcaattgtgaacagctacttctgtgttgacatctggagactcctggttcagggaaaacagtgcgggctgacattatcgattacatcttttcaaccaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctctctctctctgtgtgtgtgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccagacaagggatgggtcagtgagcaagactctcttcctagtctcaggccatacctgtggcgccctgatcctattctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcgtaactgtttgcacaaacttgggacaaatgatattgggataacgatctactagaatagggacattttacccacagtttctgggagaaaaaccgaggaatttctatcatgaccagccttcaggcctcctgaaatatatctctcacagtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctgtgttaacacctggaggcaacagattcagggaaaccagagtgtgtttgatgacatgttttcaacgaaggctgaattactcctactgtcattgctgttggttttcattgcagtagatgtttaggtttccatttcttcctccccttatcatttcctaacgtaccataggttgaccatacttcaaaagctgtactctcatggccactgcatcgaattttgagcatattttatggaaaactattgagctcactcttttcatgatcacagtttgctgtgtgtcatgagggcactaactcagagtgtcctttgactcccttaccagtatgtcacctggccaattcactaggtcactttctctctgtctctgtctctgtctctgtctctctctctctgtctttttctttcattgttttctacctggccctgttctatcccaacataaaggcaataatttgttacctcattaatggatctgtcctttttcttttcaaactcttccttacgttagccatgaaatctagctggggctgtgtggtttctgattccccctggcttgttctttactttttcccacttttccaggctcagcagggagctgctggatgagaaagggcctgaagtcttgcaggactcactggatagatgttattcaactccttcaggttgtcttgaactgtgtgactcatgccagccctacagaagtgccttttatgtattggagcaacagcatgttggcttggctgttgacatggatggtgagtacctttctatgaaggtgataaggatccactgagtcttctggttagggtcatattcctactgcaagtggcccttactgagctgagagatgtcattgccacagggaggacctataggcacatgtaggttgaatgaaactctagttccacttggaagcccagacaagggatgggtcagtgagcaaggctctcttcctagtctcaggccatgcctgtggcgccctaatcctactctcaagatgttggatctgggcagatgtgacaaattcacacaactctgattttgtctcaattttgtagatcttgtagatttcatccttcactctaatttcagcgtctaaaatcctcgctaccgtgaacaatctgagtatttgatgagacagggctgaatagtgcagtttttctcctagcaaccatttgggggcatttgctttaaatcgattggaaaaatatggcataaccatttgcacaaacttgggacaaatgatattgggataacgatctaccagaatagggaattttacccacagtttctgggacaaaaaccaaggaatctctatggtgatcagccttcaggcctcctgaagaatatctctcacagtgtcctattctcatgctgaggagcctgaagtccctgtgtgaggattagacagtggattgttatgtgtgtaggagaaccagcttaatatgtctgtccatgtctgaacttattgcagaaattgaaaagtaccaagaagtggaagaagaccaagacccatcatgccccaggtaactttgagcaattatggatgcttaattctgtgttgacacctggagatgccaggtccagggaaaacaagagtgtgttcaatttcatgttttcaacgaaggttgaattactcctactgacattgctgttggttttcattgcagtagatgtttaggtttccatttcttcctccccttatcatttactgacttactgtaggttgaccatacctcaaaggctgtatggcaactgcatggaatcttgagcaagtttatggaaaattattgagccccctcttttcatgatcactgttcgctgtgtgtcccgagggcactaactcagagtgtcctttgaccccttcatcagtgtgtcacccggccaattcgctgatctcactttctcctctctctctctctccctctccctgtctttctctttcattcttttctacctggccctggtctatcccaacataaaggcaatagttcgttacctcattaatggatctgtcctttttctttttaaacagttccttatgttagccatgaaatctagctggggctgtgtggtttctgattccccctggcttattctttactttttcctacttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctattccaagtggcccttactgacccgagagacgtcattgccgcaggcaggacctatgggcgcatataggttgtaatgaaactgtagtctcagctggaagcctagacatgaaatggttcagtgagcaagactctcttcctagtctcaggccatacctgtggcgccctgatcctattctcatgacattggacctgggcagatgtgacaaattcagagaactgtgattttgactcaagggtttgtagatttcctttttcactctaatttcagtgtctggagtcctcactaccatgaacaatctgagtatttgatgagacagggctaaatattgcagtttttctcctagaaatcattgagggtatttgctttacgttgattggaaaaatatggcgtaactgtttgcacaaacttgggacaaatgatattgggataacgatctactagaatagggacattttacccacagtttctgggagaaaaaccgaggaatttctatcatgaccagccttcaggcctcctgaaatatatctctcacagtgtcctattcttatgctgaggagcctgaggtccctgtgtgaggattagacagtggatttttatgtgtgtaggggaatcagcttaatgtgtctgtccatgtctgaatttattgcagaaattgaaaagaaggggaaggggaaaaaaagaaggggaagaagatcaaagaaggaaagaagaaggggaagaaaagaaggggaagaagatcaaaacccaccatgccccaggtgactttcagcaattgtggatccttagttctgtgttaacacctggaggcaacagattcagggaaaccagagtgtgtttgatgacatgttttcaacgaaggctgaattactcctactgtcattgctgttggttttcattgcagtagatgtttaggtttccatttcttcctccccttatcatttcctaacgtaccataggttgaccatacttcaaaagctgtactctcatggccactgcatcgaattttgagcatattttatggaaaactattgagctcactcttttcatgatcactgtttgctgtgtgtcatgagggcactaagtcagagtgtcctttgactcccttaccagtatgtcacctggccaattcactaggtcactttctctctgtctctgtctctgtctctgtctctctctctctgtctttctctttcattgttttctacctggccctgttctatcccaacataaaggcaataaattttttttttacctcattaatggttctatcctttttcttttctaaccacttccttatgttgcttctgaaatctagctggggctctgtggtgtctgattttccctggctgcttctttagttttgtctccttttccaggctcaacggcgtgctgatggaagtggaagagcgtgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttagtaatccgagagatgtcattcctgcaggcaggacctataggcaagtgaagatttgaatgaaagtacagttccatttggaagcccagacataggatgggtcagtgggcatggctctattcctattctcaaaccatgccagtggcaacctgtgcgcagtctgaagacaatggacccacattaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctagactcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaagacaggtcagctgtctggctcaatgatctacattctgaagttgtctgaaaatgtcttcatgattaaattcagcctaaacgttttgccaggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttacaatgaagtacttgggaaagtggttttcaagagtataaatatcctgtattctaatgatcatcctctaaacattttatcatttattaatcctccctgcctgtgtctattattatattcatatctctacactgcaaatttggggtctcaatttttactgtgcctttgtttttactagtgtctgctgttgcaaaaagaagacattctctgcctgagttttaatttttgtccaaagttaattttaatctatacaattaaaaccttttgcctatcactctggacttttggattgttttttacattcagtgttataatatttgattatggtgattggttttggtgggtactgatgcgaattaataaaaacatttcatttccatgtttattttctaatctcttccacattgtaggctatgtttaccatatgtagcagaatgtatttacatttcttggttctagtcatttgtattcttcgtgagtgtgagtgtgtgtgtgtgtgtgtctgtgtgtgtgtctgtgtgtgcctttggcatttaggaagggttgtatagctcatgttaaatattgcactaaaaatgtttttgatggttttcctccctttggactagacacacttctaatatttggtttatagttttaaattataactttcagcatcaaatatttccatacaacagtcaattacatgatgtgttttctttttcctacctcctttacctgccacttctcataatagtatttgaacctaaacatataccggtgacattctgtgattatcatcttgcccctaccttggtttttggtttagatccacattgaaatatattaacgctcatgagctattcaaaagtgaatgtcacagtcgtcacttgctgagtggtactcatccttaacagagtcctcatgagggaatcaggtctcgctgagtttagcatgtttaataatcttttctcacggtctcgatacatggatcgcattactagatataaggtgcttgcccaaaatgatttttctggagtttttaggagatattgtcttccttgggggacatacatggtgtatgttctcattgtgggattctattttgttctaccaggacctctaatttctgccagttacttcattcatttgttctcttcaccatgagtctccagaggatacttccatggtccgtgcctccccatctcccagcaattctgcatttccaagattggcacctctggtcctctgcacggtgaagccccttcctttcaattccccagtagccagtgctctaatccaccaggtctcaggcatgatctatgtttctccacactcgctttctgaggagagttttgcctgggttctatcatgaacaggccctccctgctgtcctggcctctatttgcatagtgtttcctgctccctctgccgtcgtgtggctcccagacctggctaaagaaaatcacctgagggccacagtgttccctagccctggtgtttagggcaggattatgggtgagatttttgagtctctaagttgacccctacagctctgaagtgtatgttgagaaattcagctgttatcatcctaggtggacttgctccctcctatcctcctacttcaaatgcagaacttcaatcgtttacaaaagaagactgaatcgtataatagaacacacccttattcattggctggcttcaccaatctcatggctgaacttgtaaaaatacaatcttagccacatacctatgaaatgtatatgtgtgtatatatatatacatgaatttgcttctgagattatggaggctgaaattcccaagatggaaggaaagctggatacccaggaaagcatttgtttcccattaggcctcttaattctctcctggcccttgattgattgcatgaggcccacccctattaaggagggcaatctgcttcacttagtctgcccatcccaatgttaatcgtatctgaaagactctctggaacacaaccagaatcatgtttggccaaatgtcctggcaccctggtgctcggtcacagtgacaagtacaagtaactatcacacatgccctttgtcatattggtgatttccactgtttttctcccaaactgcagcttatatttgttctcttaatactgttgagcaaaaatttttaatttttataaagtcgaatttatcaatgttttctttaatggtttgtgtttattgataataaagaacactttgcctaactctgtgtcatgaagattttgtcttatattttctgctatactttttctagttttatagtttatatttagttgcataatccattttgagttagtttttgagttagtattgaggttcaggtgaatttttttcctttggggataaaaaaaaacaaattgtgtaaaaaaaagttgtttctaaacaatttgttgacaagagaatgccttctccactgaatcatatttgcacctttgtcaatccattgggtggttgagactggtgagaggactgtcctggtgtttggacagagagacagggcatgaagtagggtggttcttatgggaaaaattaaggaagacacatttttccatgaggaataggaaatccccaagcacaattggtggtaccctctaccagcatgttgtagcacattcatctctgctctacctgtcctgctgcaaaagcttgggtgtgcatagacactgaggttgagtggtgtctttgggcattttgagcattgacaccaaagttccagcatcaaatcttagaatatcaagcagccagatggatcacctgaggtcaggagttcacgaccagcctgactaacatggtgaaaccccatctctactaaatacaaaaaaattagccaggcatgatggtgcatgcctgtaatctgagctacttgggaggctgagacaggagaatcgcttgtgtacctgggaggtggaggttgcagtgagctgagatcacaccattgcactccagcctgggcaacgagagcaaaactctatccccccgcaaaaaaaataaataaaaataaaagaatatcaagcagccaaagaagcaggaaaacatgacacataatgaagaatctaataatctagttgaaattgacagacatgttggaaatagaagaaaaggacattacagcagttagtataattgtattttaattaaatggggaggttgaagattttttaaatatcaaattctgtagataaaaagtatgatttacagtctgaaatggaagaaggcagtggattaaacattgcagaagagaagattattgaactagaaggaatagaagttgaaactaacataaatgaaacacacagtaacaaatgacttgaaaacataaaaacaccatcggcatcaaaactttaaacgccccagtatagggctaaatggaatccctgaagggcgtgtagtggagaagagagacaaagatatttaaaacatactggatgaaagatttagaagctccatggaaaccataaacttcaaatattacagaaatatgattattctaagaacaagaaacatgaagaaaacttcaccaaggaacgccttaatcaaatccatcaaaaccagtgataaaaaggaaatcctaaaaggaataaaaagggaaagaacatgttacatacagagcactaaatataaggatggcataagatttcacatacaaacaagaagtttgcaataaagaacttaaaaaaagaaaaactgtcacctacaattctacacctggccaaattatcttttaaaaataaacatgagaaaaagtatttttgaacagaaaacaaaatgatctcaatttgcagatggtgtgatcctatgcatagaaaatcccaaataatacctacagatgcaaacacacatacatgcacacagaggccagacacacacacacacacacacacacactcacatacacacactactagagttaataagtgaattcagcaaactttcagtaaacaatcagttgtgttagcaatgaacaatctgagaagaaaattgacacaatgatttcatttataatagcacttgtaagaataatatgcctgggaataaatttgttcaagaaggtgccgtacttgtacacagacaactacagaacattgctcgaggagattcaggaagacctaaatcaatggacagacatcttgtgtccatgggttggaagttgtaacatggttaagataaaaatacaactcaaagcaacccacagattcaatacaatcctatcaagaagtggccttttttacaggaatgcctaagaagaacttcatattcctaaaaaatagtgtgtccccccaaaacaaaagcaatcttgaaatgcaagaagaaacattttctattccaaaggtctttaactgctctaagcagtacttggtagtcttcaatatataggctttcatatctctttttttcttcttttgtttctgcacaggatctcactctttcacccaggctggagtacagtggcacaatcacagctcactgcagcatggaattctcaggcctatgacatcctagggcctcatccactgattcctgggactacaggctcacaccaccaaacccgggtaatttttctgattttcagtagagatgagggctcactatgttgcctaggctagtttcaagcttctgagatcaagcaaccctcctgccacagccttccaaagtgctgggattcgaagccaagcctggctggctttcatgtcttttctatgtagtttatgtttctggatgccattgagagtctggctggctttcacatatttgctatgtcgtttatatttcttgatgttattgtaaatgtttattaaaggaatcttttaaaaactttgttttggccaggcgcggtggtccacgcctgtaatcctagcactttgggaggccgaggtgggtggatcatgaggtcagaagatcgagaccatcctggctaacatggtgaaaccccatctctactaaaaatacaaaaaaaaaaaaaaattagcctggcgtggtggcgggcgcctgtagtcccaggtacttgggaggctgaggcaggagaatggcgtgaacctgggaggtggagcttgcagtgagccaagatggtgccactgcactccagcctgggagacagagtgagactccgtctcaaaaaaaaaattgtattaaaattatatatttaaggaattacatatatatttatatatatataatacatatccttaaactatatatatttaaggaatacaacctgaggactacatatacatatacataatgaactaatgcctactaggtgaggggctgccttgtgagcaaacccaaggtccctggcttatgaagcctttgtctagaaggagggagggatcagcaaggtgggcacgcagcaggttctgtctttggtgtgggcatctgcccactcgggtctctggcaatactaaccaggcttcacgatgggtgaggtgagctaggaatgggaaagtggatgacttcagatccagagactgcagttgtcacctggggacctggcgtaggcgtggaggagtctcccactgacttggccctgggtcaatgcccaaacatgcacaaggacgggactctcggcctcaatgctttaggagcccccagtcttctaaagagggtttgtggtggggaacaatgttcaacaaaacagaagagttatgggtgctctagcttggcaacggagaatacttccttgtgctactaaatgccaatatttgacaattacggatgacacaattgagcaacagcattcactgtttaacaagcagtgtctctggaacactgggttagtgctgtcagatgttgactgaaaagtcagtggtttgagcccatccagtcatattaatgtttctagctgacgtgaccttccatctgaagagtctcttccttggaccaaatatctcttaaagcttctcttcttcttgtctcttgtctattttctaaggtgcctctttgttgcttggggcaaaaaaagtccatttttaatccacacccaacaaacatctacccttacgtatccggtttttagggttttgagtttgttgtttgttttctcagcttctcatatttggaatactggaaattcctaaagtggagaatgacagaacgtgaatcacagctatggtgaagccacaggctctggatgaaaaacctaatctgccagggtttgaagttaaacacattaatcttctctgcctccatttctatctgtccaatgggataaatcagaacacttaggttgtccagtgtttaaatgagcagtgcaggaaaagcatggagccaatgcctgtcacgtagtaattggtccacacgcatgagctcctatcagctccatggtctccagcatttccatcaggttttgatctttgaaatgtccttcttgatatgaatggatcattcctcaaacattctctaaccgatggccatgaaattgctccaatgtgtattattacaaatacaactgcagggaccagactgacacatgtatctgtcgtgcatcacttgtctatttctctgtagacacctggagatggaattgtcagaccaaagtatttatacatgtttgattttgctaatttctgtctaaattactgtgaaaagaagatataacaggtcatacctttaacattttttgagaattcttttttctccatcttctggccaaaactgggaagtacttgcctaccatttcctctgaactcacttttgccaacatttgtgtagtcatacagtgggatcacattgtatgcaagacatcaaactcaaatccttaaatgaaagcgattaacatgactgtgtaaaaatttatcttcaaaatacaatgaatacatatatacacatacttatatgggaaaggaattattttatttggatactttatcaaagttatatatatttgaaaatttgtttagtaaaatagcagtccccttgtgtactcccagagtttcatcacatagaagcaattatttcgttatttatctccttatgtctaaatagatattattactttttgattttcaagtttaggcactacctctccttcacatacttgctcatcaccaccacccccaaacacgcctctcaccaccttaccctccaacacgtttgtgtcctcgtttgctgggtcaattgctacattgttataacttgtatattttattcagagttcagtcacattggatatacatagcaggaatgagaggccagtatcttcagggactctctctcaagtagataagcttcagagatttttgtaatctttggtcactctcttcatctttttcgtattccaggtaagtactggatctgatgggcccagctcaggtcaggcactctctccttgagcaggggagagcgggacatcttcatgtgtagtaccaggaagacactgtccaaagagggacaggtagttctaagacagaaaagtctgtctggggtacaggtaggcaaaacaaggacacacacacaaaaattagtctgttctgtgaggggagcatgcagtagagggtggattcagagtgggaggggagagttttgagagatatgggccatggatatcactctgtgggccggagccacacaagacggttggggtctctcaggggcagggagctgaggaggatctgccctccccaacctgggagactggtgaggggactgtcctggtcaccagacagaaatggggtctgggccagggcagttctggtgggaaagaaagaacaggacatctccttaaggaaaggtcctgagtcaggtcttggcagggagggaggttaccttgctcattggcagctgaagatggttggccagatgagggcactgaaatccatgtcctctaaacttgtagttctagtaaaagaacgacagcagtaaagggtctttaggaagaggaggtggaagacctgatttgggttgggggctccaagaagaatgtctgccttgctgtgcagaagcctctgcataacctccctggtccccttgctcagtctcctggccagacccctgtgagccctggaagtgcacagtcagcttagccaaggcatctccagccaggactcatccctgggcatttctgtggccttgggttccctggcctccaggccctgtcttgcaggcaatcgtcctgctagggaagggggaaaggaggctacttgacagttaactctgagcggttccacaaggtcctgacttagctcctagtcacttgcaaacctatatacccccatctcatcccccaaatgatgaaaagaaactttgcaggactcatgccagacaaatagggtgggaccattctgtagagccaagttctcaggacatcaataagagatggaaaccacctgctggaaggtgccacagtgggaactttggggtcagggagcagtcactgaactgtcagggtgaatcctggctcctggccctcacacaccctttctccccctccctccttctctcctccctcctgtctgctctttcccctctctctcctgaatccctcaggtaccttccatgggccctgacccctccttttcagaggctccaaagtgagccctcaaaacacttggtaaccttggacacttccaaaactggagagacttgaccacagcatttttatgagctaggaaggtcctccagagctcttgcctaaatttttctgctgatgagaagagaacaagagtttccatctgatctggtcctaaggcaacttctccttggagcagagtctgggcaggaagaagggggttgcccagggccctggacttgcccctcccagctgctctgctcctctccccttcactgcgggaggctggccagggatcaggaacctccgttctccacagatgctgggattccaggctcaaatctaaatattggctgatttaggaggcgaagggaggcaattccctggagggaggtgtcaggatttgggacaagagcagcatctagttgtcatccacagagaccccaaggacaggaatccactggtagccggttggaggggatcccatgaaaacaagatgaaacgcgccattagtactggacccaagatcaggagatgaaaaactgcactgtcctaagggatgaaagaattagggaatcctggaagtaaagtttttcatataggtcatttcttccaaagagacatagggcaatggcccaatgacgtgaacaaaagaaaactcggggtctaggattgaggggaggcagcctttttagtggagacctgtgacctggaggcccagggtcaccctgagaggggaggggtcttgctggtcgctgggtccgggactccaattgcacacagccagtggcatggagggtctgtgaccacgattgggcaatttcccccattctgcttatggagcaatagagaggaacctcactggaattatacagaaaggtcccagtgagacttgaactctgatcactgtattcagagtccaaagtgctcaccattacaccatggaacctcacactagcttataactggaggtaactgagttcatacttagcagccatagttcccacacacctatgttaaggcatttcttctgatccctcaagcaacaccaaggaaggtggacctgcgagagaggagtcatcctctttctttctttctctctgccctctcctttgatcaacttttatcatttcatttgcacctcagaaaatgaggcaaaatccagtttgggcttagggccagagaagagcccttgaggcctccctctggaaaacatactctctcagtttaccagagtttcctgtaccaaggggaaatttccgcaaacagtagtgttatattctttttgccttccctcttttccctttgcccagggaggccagatgattgtgagaacaggacttgggacttcctgtgtgtcttgcccccttcctccatgtgataaataatggctgacaccaagcaagtgggattgggaggcagggaatctttcattttcttcttcatatacttctacgcatttgtttggttggttttggcaagattttctcaccagaaatggagatttgttggatttaaaataaaaagtaatcagccatgttttacatttctataaaacactcaaaccaggccatactcccctgctgtgcctcaaaatcaaccataaactgtcgaggtcaggaggcagggccctcacacttaagcacagtgtgtttcctcagaattggccaagttgatgccactccaatttctcaatataccacaacccattaattgcggtttttaaaagtgtacatgtatttttaccaaaaccccagggcttcagtgttctcagcacacagaaagacaatcattgagacattgagtattgctgaggaagaaggctttaatcaggtgctgcagctgagtagacaggagatgagtctcaaatctgtctccctgattgactaaagttaggggtttatatagcgcagaagaaaagttaactgtgtgtgggaaaagaggaactagagaggggtgaggaagcactcgtgatgagtgaggggactggcatctcattgtctggatgctgtgattggctgagtttcgggtctctgatgctttttgagaggcctgagagtcctttcctgaggaaggaactcagataaaacaaatataagtttgttttatagaatggcttgacctcaggagtttgaaaccagcctgggcaatatggtgaaaccctgtctctaccaaaatacaaaaagaaaaagagggttgcttccaagatggctgaataggaacagctccggtctacagcttcaagtgagatagatgcagaagacaggtgatttctgcatttccaactgaggtacctggttcatctcactgggactcgttggacagtggatgcagcccacggaggatgagccaaagcagggtggggtgtcgcctcacccgggaagtgcaaggggttggggtatttctttttcctagccaagggaagctgtgagtgactgtacctcgagaagcagtacacccctgcccaaatactgtgcttttttccactgtctttgcaaccgacagaccaggagattccctcttgtgcctggctcggcaggtcccatgcccatggagccttgcctgctgctagcacagcagtctgagatcaacctgtgacactggagcatggcagggggagggggttctgccactgctgaggcttgagtatgtggttctatggtcacagtgtaaataaagtggtagggaagctcgaactgggtagagcccactgcagctcagcaaggcctactgcctctagattccacctctgggggcagggcatatctgaataaaaggcagcagacagcttctgcagacttaaacgtccctgcctgacagcagggactgctgtcataatcattatgattatgaatcataatcatgaagacaatctgtattccagaatagtaagggaacctattccatcagggagccaactgaaaacatcaaatcccagttcacaccccagggtgtggtgtcatgcacctgtagtcccagctacttgggaggattagtaaggaggtttgcttgaattcgtgaggtcaaggcagaagtaaaccctgatcatgccactgtactccaacctgggcgacagtgagaccttgtctcagaaacaaacaaacaaacaaaaaaccccacaaaaccaaacaacaacaaattgtcacctcattctgaaatgacagtggcaaacatcactttgctatttgaaaattaaaagaagccgggcgcggtggctcacgcctgtaatcccagcactttgggaggccgaggtgggcggatcacaaggtcaggagatcgagaccatcctggctaacagagtgaaaccccatctctactaaaaatacaaaaaattagccggacgtggtggcaggtgcctgtaatcccagctactggggaggctgaggcaggagaatggcgtgaacccgggaggcggagcttgcagtgagccgagatagccccactgcactccagcctgagcgaagagcgcgagactccgtctcaaaaaaaaaaaaaaagaaaattaaaagaaaaacactccctcttgctatcaacctgccctcttgctctaacttgtctgacccatggtttaaaatgcccaaaagctgatgtactcaaattatagtacacttacctgttctgcaccagcatttacttttgtctggaggagatcaccatgcatggtcctatacatgtctaatggcatggaatgatgaagggtagtgtcttttaggatagttggatacatatatatatatatatatatatatatatatatatgcggaatgctacatcacaagaataagaatgtgaaaagaaccagtttcttttgtaatcctaaacgttctagtctgagaattaaaagccattgttcgaagaagggtgcccagggtccagctggtcgccgaaagcttgctccgcaatacaggctaaggaccagc

SEQ ID NO: 310 - DNA, 532443 bp, Homo sapiens
  misc_feature (411054)..(461053): n is a, c, g, or t
ttttattcacaaatatttattgaactgccataaaaagactgagagtagtatccaaaaggattaagcccagaatgaaggaatgcttgtggaaaaggaaaacgccaccaagagatatttctaaattagccacctaaattaattaattaatttaattaattgatttctatattagcaagaaaatttgagaggaaatgtcactgctgggggacgataacaaaagttaacagataagaaagagggcagaactactaagctaccattgcatgcttggagagaatagaagagacctcacaggtgagaagacagtaagagatttaaatgaatacagtttgtcaggctcaggtgaatccttccccagaggacttactgagcccgcagctgtatttttagagtgtcttcaataatctttgacaacttgtgaagatcagagaagtgctgcaagttcaaaaaagaacaaatatcccagttttcaaaataatgaaagtgatatattccaaaaagaaatcttgatgttgatctttgtcaaaattcaagaatggattattgaacagatggtatgtgagcacttggaaaatggtgaacattagaaaccagaatttctctaaaagcaaggtaggacagattaagtgggacgaaaggttttgcagagagagagatgcaccattctccaggctgcggtggatgttgagccagcatgctcttccccaccaacatagggccttccttccctgctccttagctgtttgtcagggcagatgtgcttggggtcatcttcctgctgagctctgaccccatgataataaatcaatcctccgtgttcctctcaccagagcactcccaggaaatggaaagcctgagggaggctctgctgtcctctcaatcccaccttcaagagctggaaaaggagctggagcaccagaagatggaaaggcagcaacttttggaagacttgagggagaagcagcaagagttcttgcatttcagggaggatcgtctttccctccaggaaaatgactccaggtaagaggggacccattgacacagaaggtagcattcttcattcttacattcattcttacattagaagaagggatattggcaagacaattggtgtcctcttttggaaacctcaacgttccctctgctattcctgatttttgtgtgtcagttgttggataggaaggcgctttgagcagaagaaagtacttctctgggaatgccttgtcactcccaagttgagagagtaaaactctgttatagaaatcttcagtatatcagagacatgacaaggaagggttcccatgcttccaattaggtataggacattagtctcaccatcgcctaggaagcttctatactggctgtgatgctaggtcccatcataagccctgtaactgcttgtcagaatgaaaagagcactgtaggagcagtaaggagactgtgctggtgtatctgttctgctctgaactaatgtaggtaatggtgtgttttcaagcaaagttacttgacctccctcagccaccatttccacatctgcaaaataaaagtgatggtcttcatgaccccctgagttgacatctggggctcagatgtaaccctacccataaacctttatgaacccctgggttgacatctggctctcagcttattgctctggtgtgactgagtggccctgccatttcagtgggccttgccgctccctggtcagactgcagcacaagctggtcctcctgcagcaacaatgtgaagagaaacagcagctctttgagtccctccagtcagagctacaaatccacaaggcactttatggcaattccaagaaggggctgaaaggtttgtgttcttctccccttaccccatgaactttttgctcttgcataggatgctagtgaggtctttcctttgggagttgtggagatcatgggaagctacagagttctgtctcagaaaccccacccaagcctggggctcccagtaggaactctcatgcacaaagcccaaggtgacaggttggtagcacgagcaagatccagcctgatcattcttaattactttaagaaaatctggacattcccattctagacattcctatcaatgtctagaatataactttttttttttttttttgagatggagtctcgctctgtcacccaggctggagtgcagtggcatgacctcggctcactgcaagctctgcctcccaggttctggccattctcctgcctcagactcccgagtagctgggactacaggcacctgccaccatgcccagctaatttttttgtatttttagtagagacagggtttcaccatgttagctaggatggtcttgatctcctgatgtcatgatctgcccacctcggcctcccaaagtgctgggattacaggtgtgagccaccgcacctggtgattataacattttttaaagcaaaagaacagtcctaatgatatcatttgaaaaggcctctaatattgtcagtgatacatactgacaacccattcagcccaatgtagcaggcagtctgctcccaccctgaccctttccctagtgacatctggctctcagcttattgccctttcatttaattttcataaatcctgatttagtttcctgattttctaaagagaaggtgaactggaatttgaagaaatacaggggcttaccaggctcggtgaatagcttaagttcaaagtcatggtgagtgttgagtcagtggggaccagcctgcccacaggagaaaattaaaagacatgaaaacaaaaaaacttcatagaaataccactaataagacctaaatttcaatcctggatttaaatattaaggacattttttgaagactttgcttcctactgaaataataatctaatatttgagaattttgatatatttcttcattcttctttaaatggaggagagtactcaaaacataacgttaataagtcacagcaggctgggacagagggctgacatcaatgtcatgaaatttagcaaagattaaaagcaaaatcctgagctcgattaaaagtatcagtggtagaaatataggatgagcatagaaatataggacaggcagccattcatggacttcagggtttggggtttggtagaaacatgttcacacaagaatggcataggcaaaaggatgctagaaataccagctcaaaataacactacagtagtgtaagtgtgatgttcacctgtggagaccatgtctaaaatattgttagattatggggcaccatctttgaaaagggcattgacacactagggaacataatgaagacagggcgcacaatggtgtgtaccagacatcttgaactggtcaaagaaactaaagaaatttaggctttcaaaagatcttgaggacatgagaactggcttcagatatttgaagaactgtcaaggtgaaaaagaactcatgtattttatgtccctccagagggctaaacaaagagtgaagggcagtggaatttagattggaattatcataaatcctgatttagtttcctgattttctaaagagaaggtgaactggaacttgaagaaatacagaggggctcaccaggctgggagaatagcttaagtacaaagtcatggtgagtgttgggtcagagggaccagcctgcccacaggagaagcttggggtttggggagtgagaagtcaggatggtggagcagagtcatcaaatcttgaaagcccacaggtcagggggaaagttgacattctgtacagtagataatgaaactaagtctgttctttttcaaagaagataagtatatgatgaaaacagagctttcagatgctaagtctcaggggatgtcctggagttgggagacgttagaatctgggaaacctattggatgggtctagtgatattctggcacattaagagatgacagtctaatataaggtgctattgggaagatgaaagggtatagatagatttaaaaacatctctttaaaaaataagcaaaatttaatgagaacttggattgagaaagagagagagcaacatcacaaaactttgggcaaaattcaagagtagattatttaccaaagtctctaaaactaattcatcctgagctacctttcctttcatgcttttctccctgccttttaggactcatttcagagctacaaccactaaagctccataatctcttttttttttttttttaattatactttaagttttagggtacatgtgcacattgtacaggttagttacatatgtatacatgtgccatgctggtgcgctgcacccactaactcgtcatctagcattaggtatatctcccaatgctatccctcccccctcccccctccccaccacagtccccagagtgtgatattccccttcctgtgtccatgcgatctcattgttcaattgttcaatttccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccttgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatgatatctcattgtggttttgatttacgtttctctgatggccagtgatgacgagcattttttcatgtgttttttgactgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccgttgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgtttgtttttctcaggtttgtcaaagatcagatagttgtaggtaagcggcattatttctgagggctctgttctgttccattgatctatatctctgttttggtgccagtaccatgctgttttggttactgtagccttgtagtgtagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtctgttgttggtgtataggaatgcttgtgatttttgtacattgattttgtatcctgagactttgctgaagttgcttatcagcttaaggagattttgggctgagacgatggggttttctagatatacaatcatgtcatctgcatacagggacaatttgacttcttcttttcctaattgaatcccctttgtttccttctcctgcctaattgccctggccagaacttccaacactatgttgaataggagtggtgagagagggcatccctgtcttgtgccagttttcagagggaatgcttccagtttttacccattcagtatgatattggctgtggatttgtcatagatagctcttattattttgagatacgtcccatcaatacctaatttattgagagtgtttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatgatggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctgttgattggaatagtttcagaaggaatggtaccagttcctccttgtacctctggtagaattcagctgtgaatccatctggtcctggactctttttggttggtaaactattgattattgccacaatttcagagccttttattggtctattcagagattcgacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgatttttagaagggttttttgtgtctctatttccttcagttctgctctgattttagttatttcttgccttctgctagcttttgaatgtgtttgctcttgcttttctagttcttttaattgtgatggtagggtgtcaattttggatctttcctgctttctcttgtgggcatttagtgctataaatttccctctacacactgctttgaatgcatcccagagattctggtatgttgtgtctttgttctcattggtttcaaagaacatctttatttctgccttcatttcgttaggtacccagtagtcattcaggagcaggttgttcagtttccatgtagttgagcggctttgagtgagattcttaatcctgagttctagtttgattgcactgtggtctgagagatagttggttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttcagcctatgtgtgtctctgcacgtgagaagggtttcttgaatacagcacactgatgggtcttgactctttatccaacttgccagtctgtgtcttttaattggagaatttagtccatttacatttaaagttaatatcgttatgtgtgaatttgatcctgtcattatgatgttagctggtgattttgctcgttagttgatgcagtttcttcctagtctcgatggtctttacattttggcatgattttgcagcggctggtactggttgttcctttccacgtttagcgcttccttcaggagctcttttagggcaggcctggtggtgacaaaatctctcaccatttgcttgtctgtaaagtattttatttctccttcacttatgaagcttagtttggctggatatgaaattctgggttgaaaattcttttctttaagaatgttgaatattggcccccactctcttctggtttgtagggtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttgattccattctccgcatcactttcaggtacaccaatcagacgtagatttggtcttttcacacagtcccttatttcttggaggctttgctcatttctttttattcttttgtctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcgaagttttcaacttctttgcctttggtttgaatgtcctcccatagcttagagtaatttgatcatctgaagccttcttctctcagctcgtcaaaatcattctccatccagctttgttccgttgctggtgaggaactgcgttcctttggaggaggagaggcactctgcgttttagaatttccagtttttctgttctgttttttccccatctttgtggttttatctactttgggtctttgatgatggtgatgtacagatgggttttcggtgtggatgtcctttctgtttgttagttttccttctaacagacaggaccctcagctgcaggtctgttggaattccctgccgtgtgaggtgtcagtgtgcccctgctggggggtgcctcccagttaggctgctcgggggtcaggggtcagggacccacttgagaaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaagcaggcaggcctccttgagctgtgatgggctccacccagttcgagcttccccgctgctttgtttacctaaacaagcctgggcaatggcgggcgcccctcccccagcctcgctgccgccttgcagtttgatctcagactgctgtgctagcagtcagcgagattccgtgggcttaggaccctccaagccaggtgtgggatatagtctcgtggtgcgctgttttttcagccggtctgaaaagcgcaatattcgggtgggagtgacccaattttccaggtgcgtccgtcacccctttctttgactcggaaagggaactccctgaccccttgtgcttcccaggtgaggcaatgcctcgccctgcttcagctcacgcacggtgcgcgcacccactggcctgcgcccactgtctggcactccctagtgagatgaacccggtacctcagatggaaatgcagaaatcacccttcttctgcgtcgctcacgctgtgagctgtagaccggagctgttcctattcggccatcttggctcctctcaagctccataatctcttatctgtaatttcaaaatccagtaagatctccaaattaaatttttcaaatagtcatttagtgacaaaatctagatgaactgacaagaagatattcataagtctttatttatctacttagaatgttcacatagctcattgcagaaatagttatatgtttgattaaggattgtggctcacctgcaactgggtacatgttatatacgatatatgcaccctgttgccttgctaaaaactaaaacaaaatttactttttgagatacatttggccttaaggttttcagataagggattgtggacttgtagaatatttcttagatctcttcatccccagtacaaagaaataaactacatgtggtgaatggaggtaaatatatatacacatatatatttttatatatgcatatatatttatatatacgtgtatatattcatatatacatgtatatatttatatatatatgtgtgtatatgtgtgtacatatatatgtacatatatttcatatatacacatatatagtatgtatatgcacacaacatatatacacactatatataggtgtatatatgtacacacgtacatatatacatatatacatgtatacacatatacatatatactgtatacatatatatacacacacagagagagagagagagagagaagttgaaaaactcacttagttataatccctcgtctaagttgccgaactcatatcctcacatgctaccaaaaggcctcctccttctcctctttcatttttgagagtgaagactgtcaaatctctttctccttcatcccctacccttctctagctcagtgctgaccttctaccttggaggatcctatactttagcctacaggactaaggttactatggagatgaaatatggacttatccttatctgccaatcaaatgctctataggtgcatgtgtgtaacttaaaccacaaagaagtttcagactggatgtgtgccagctcagtgccatccccaggccacacacagaaatgatgacatgtccatcatagatgggttgcatgagactcagatgatagtggggtccttggcagaaaagagtgtcacagaggagggttctgacaagtgcttggaaatacttgggtcaatgttaccagactcctcttctctcttaggttacagcctggatgcttgtcaccaaatccctttgagcagtgtcctgagccacctggtgagagaggtacgaggtctgagagggcagctggagcaaagcattcaggggaacaattgtctgtgactgcagctgcgacagcagctggatagcggtgctggcaaagccagcctcagccccttctccattaacaagaacttcccagccagcactgaccctggaaacaaacagctgctcctccaaggtaggaaggaaaagggacttagaaagctctcagccagtggggagatcaccaggatgtctgcagcagaaggtgcaatctgcctggtctatgctccttagggtcaggttgaaatcagagatgctctagtctagcagcctgagtgaaagtgtgggatttaggccaggccaggctccagattctgagtttaccacttaaagatcatttgatttgggcaaggtgtttaaagtatcagaggtttaggccttagtttccttatatttaggataataataatatataccttatatgattttgagcattacatgaaatcatttacaaatgcttggcacactaagaattgctcaataattagtagctgtatatgttcatatctttttcttggatttgcttagtgctttagtattagcgaagtgttttcacatatagaatttcatctgtagtaaagcaggttttgctgtctctatttcacacaagaaaacttaggtcttgagatattaacagacaagcaagggtttagagaagttatagacaaagccaggatcagaaccagatgttgtgattttcagtctgtgttccttccagctcattgtgttctgtctcagtattgccgaccttcccagattctctagtccccctttccctcacaggtggggaactcagtgtgtggcaaaatgttcctgcccttaaggaaacagggctctggggaagttctggacggtgggcaatttatttcgggtggccatcattcactctctacccctccccttgcctgccttttcagataggcgtgtttgaccaggacccccttctcttctcgatatcccccatcaatctcacttctcccagttttaactgaaatgtcaatggtgtccccctagtcttaaatcattcaatttctacttcctctgtctttttttccttttgatacaccatttagtacaccatctccactcacctccatggccataccttcaattttattcaaatcaggaaccactgtttggtttcgctaaagctgagctttcactctcctgccagctatttctgggtcatgttaatcttcatttttctctggttcttgtagatgcttgtttatctgacagtaaccttatttgtcaaatgaaggtgacaataacatgattacgctgcgttggcaattcagtgaaaaaacacatgtgggccgccatgcaaaccgcctggctgccaggaacttctcagcttacattaggtggatgccttgccctcctctgggctgcgctgatagttgtggtgttcagttatgtctccaactcttccttctaaacaggccttcccctctcactggcttcccatacagcagccaagaagccccactggcacagtccctgcctctctttctctagcactcccgaggcctgagccagaaagcaggcactgggcaacacttgcctgagcaggaccttttctaccttctttgtgatattttcctattcctctaccatagggttgctttttagtctccagcaagacaatgttaacccaccaagacttccatctccgttctttagacacaagtacatttttttcagtattaccctcatcagaatgatggctagaaagttgagtttagtcccccatgaatccttttattatttgattctacattttaatatgtactatgtatatttatacatattacatttagttacagggcatcgtattagataccacacagagattatactcaagacttggtttataaaaatacacctaataatttttcaaactagaggttactttctcatggaacatccctcaattaaaggaatatctttttgttctgaagaatggaaacattctgaactcagtgactcgtgggattttgcttttcttttgcttgtggcgtacgcataattctgtaagaggagagtcctgccaccttaggcctcagtggggatggctaggtgtgcatgtgcttcatgtgcagtgtgttccagggctcctgaaaactgtggttgcctttactccccagattcagctgtgtcccctccagtctgggatgttggtatgaattccccagctctggtcctccccagctctgtttcctctactcctggctcagaaacagccataatcaacagaacaaatgctaaatatggcaactaaagggcccagggactgatgatggaaagtgattaacgcaaacaacctttttttgtctctaaacatattatctgtatttagagagttttctctgcatgccccaaggcctttagccctactcactgcaccttctgtggctggctttcttgccattattcatcctccaatagttttcctattgctgtttttgcttcattgcaccataatctctccattcttgaaaatgttctctgtatccagcttgatttccttgtctgtgtcttctctacccagaaacttattatttattatgatttgtcctatttcattagccaataaggaaaaaattgtctcctggaaaatttatctttaagacataatgtaagaaagattataaaaatatagaagccagaagatctctatggactttgccccagccttgcacattccaaggcttcctttcttgctccaagcctcttccttttcttgttccctgcctcttttgagttggagcaaactgaggatatcattatgaataacagaagattccattgtgttgtcattttctttttcaggcttgggtttggatacttctccagtaatgaagaccgctcccaagctggagagtgatgctactgatggcccctttgccaataagaatggccgccatgtcattggccacattgatgactacagtgccctaagacagcaggttgcagaaggcaagctgctggtcaaaaagatagtgtctcttgtgagatcagcatgcagcttccctggccttgaagcccaaggcacagaggtaatcacacctgtaggtttaggtgcactctttccctgtgccctttcttcctttgatgttaactgcttcacccacaatttttgtttttttctttttttcatgctttgccttcctcttccatgtatagcagccaggccctttcttctctatctcctattttcactctgagttctgctctgttccagatgtagctgactggatatttcccctcagccccacagaaacacgtggcattgcctagcagcctttggtagcttattatctactgcagtcatgcaggcacatgaccatctgtgggcacagtcgactcaatgggatggacagaaactgaaggatttgcaggtatatggcccccatatgtggaaggggtgagaagtctggcagccatggcatttccttgtgcagactgcatagggagagggaaggcaggcagcaaagcttgtcagagcaccttgccagtgagagagaccaggcaccatggctgtgctgtctgagctgctggagacccatgaatgcataggagcagccctgtctccacggaacccccacactagaggacaagacacacacccaagtagataagcacagtaaggggctacaggcacagtatgagaagtcatccctatgctgtgagagcgccgatgcaaatgtggtcatttatctcaggcgaggaaggtaacaggttcatagaggacacagcaagtggggtgagttttgaaagccttgtgggttctgcaggtggagaaaggcatacctggtaaagggagcagcaccttagttctgagtgctgcaaatggttgtgagagggcttcacaggttcaagcaggcccatgttctgtgcctcactcacaaaggaaacttgagcccatgcagggggaagaaagtaatctctccacttctgtggtgttacctttccccaggagcttggcagcaaaggcattcatgagcttcagagcagcaccagtgccctgcaccatgccctagaggagttggcttccctcctcaccatgttctggagagcagccctgccaaggacccacatccctgtgatgcctggcaaagtggaaagatgccagtgtcctttcttggttcaaacccagttctcctgccctctaatactgttctttctcctcaatgtcacagcttttccagaaaatcaggagccacatagtaagttgggatagacagaaacttagaggagtgtccctggagggacatctctggcccatggtggctgctttcattgcagctctaaatacatcccattccctgccagccccctggcccctggataagaaatcaaagaagaataggaaggggtgtggagaaggcagagacatcataaccctggcaatccataaatgttcagtttctttacctctctgaaatttggctgagatgaaattaagtgaaagcttcagcacccatctcccacccctcaggtcccatggtcaaatgatcacagaatgcccccatgagactgagcctttttagccactgcctggaatccctgcatatcacttaagctggcctctctggaccaggcctggggaaagtcagccacccctcaggatctgttcagagctcaggctaactctgattggcagaccctcatgtaggcaggtttcaggatcccctccccagggattctaactccagatcaatgtcaccaataccttttggatccaactatgctaattccagggagacggtgttttgccatcttcatgttggcacaaatatttacaaacttgcaaacttgcctgagtccagatctctctctccagcataacatttctgaactctcaatcttacctgtgaagggagagtgacagaactgatatcaggactaaagcaaggtcctcttcagatttgggagctttataccagcctgaagtgaggttctcttaagctaaaggtgtgtaggcctgtgctagtctgcatggggaattccagagtctcaatactcctgcctaatggcctcatccgaaactgtcctcagctggaagtattcgaggctgtgaaggaggaaatccatttcaggagagtggagaagattgtagaatccttctttgaattggaaagagccacaaagcacagggtgctttaggccttctgcctgttcagtaagagtctgtacctcttatcaagggagaattgacagaaagggaacttctggaactgagaaccaaagtatccaaacaggagtggctccttcaaagcatagctgagcatctgaagaccgccaaccagcagaaggagagcatggagcagttcatcatcagccagcgtaggttccctgagagggaatgggggaagaaacaggcagtcttcccgatgccccacttgtgctgcagatgagcagtgaccaggggggcttggggatgttgggagttgagactgatttgatgtccccaaacctcctgtgccatgagcaattgtggatgcagaggagaggaggatggggtggatagcaggagactccaagctgaatggccagaaagaaataaatgctttagaattctcatgctaagcaagtagggttaatttttgctggtgatttctactctgtggtgctcttttgttgtttcagtaaccagaacacatgatgttttaaagaaggcaagcactaacttagaggtaaggaaactactgcagcagtcagaggcaccaagcctgtccccaacccattgccatccgttagcatatcttgtaggtgacccttggcctgctttggccttccaggagaagattttgggtccacttgcaagatcacaggtcctcagtgagcatcctgctaatttctgttcccatcactctctcaccccgtcagctcctgccccagtattttggttcactctcacattgtcgtcatctctcctttttactccaatttttcttctttgatgccaagtcaggagactggagaaatgcaattcagctcactctcaaagtcattagacatccggaagtctgcctctgaatgagcttttggtagagggatcttgaggccagttatgtggtctagtcttcatgaaaaagtaaaagcaatttgcaacctaataaactgatttcactgcacactcctgtgttaagaacagcaatttgattttgatatatctttaagaaacatgacaaaagagatctgttgggtctcattggtctaaaagagaatttgttaataaataacaactgaatcttaaggggaaaaatgttatatatgtaccacatattctctacatttacttaaaacactaagtgttaaccgttccctaggaagtgctttgaagaaaaacttgaggtatatgaatggtttaaaaatcagaaactaaaccttttaacgtggacttcaaagctttgccataagcaattgagcatattcctagaaatatttctaaactgtaacctgagagaatgttgatctccatagtgtgaaaatagtgtgaaaatgacttgggccagtttaacttgctcttttttttttttttttttttcactaactcccttttgtttttctctgataattcttctctttcctaggcctctttagagcaacacttacaggattgcctctgtaaagccttattcctgtcccaggaaaggtaacccaaaaagtctcttgtatccactaaaaggtaacccaaaagtctctagtatccactggctttctccagtgtggaagctttcccctccacctcccatagatcactggaaaggacccgaggcctcggttctaatccctggcttatcactaactgctgtgtggccttggcttgtcctttaatctctatgagactgctgcacccttatctgtcaaagatggaactggacttagttgagctctgaggtccctgtggacttggcccctccacaccctcattgtggcaactggacataaacttaacagaggacccccctgcaaaatgtcctcttctttctacaacaggctgtttctgtatgtgcatgtttcatgctaagcacttctttcttgggtggacttggcaaagccctctttctgctgagacagtgatttggagagtcacctggcccctgaagagggagtggtaggatccagccacccagtgtgcagtgaatcggagcagggatctcagcacacagggaggtggggaggctccccctaacctcaggcacctgttgttcttcgagactgcagtgcatgctcttagctcatcctcttaactggctctcaccgtgctcctgtctttagtcaccccatagctctcactccagcttcaggtagccatcagtagggcctggcaatatacactgatttggtttgttttatttttgtctgcaggtgaaatccctaagagctctgccatgtactccttgtgacccttgccttccaggaaccatgcaagaagcgcagccaccagaagtccttaaaacagcaggaaacgtgggcctgtcccccttttgtgcagctacctatctgctgaggagcttctgggcctcattcctccaagtccacgggagggtccagaagagggggtcagagatgtatcctggtggagctgggagaaaaccagaaagcctttctgacagctatggaataccgttagccaaggtccacttggcccagcactaagcaaaagatgcgtagtttgcatagaaggttttgtgatactgcttcccaacagccccagcagcttgggaactagcaacaacacatttcttgcctcatcagctgtcctgagatggaaaactcagtggatataggaccctgattacgatgaatggggcacatggtcccaatgctggagctcctctggcaggttctaaaagcacactactgagcagcggtgccctgctggacactgctggcaggggctcagtgagcactactcacagatccacacctgaccctgttgggtccagtcagactgggccttggtctgcactgtagcacctgtgttctttgagttcacatcatgaatgtgacttcccagataccatttcaggcttaacctagcacatcctatttcttttcttctatgatatccaaattggactgacctcacttcaaatactctgtcccattttgtcaccctgtcttacctcagggaaattggggactgatggccagaccaattctgttgaaattcttgcatagagcaaacctgtgctgatttttaagtggcatgggagaggcccccagccacagtaaagcctagtctgtgtcttcacagtgttgatagaatctgcttgtgtgtataaatgtatgatatagatttacatatgttgctatcgccatatattgaaggccaacataactggtggacagggtaggtgagagaaaatgaaagtctttttggtgattattaaagcaaaatgtgtataaagaaataaatagtttttctttcactgctttgtttcccatttctgcaccaatcccttgacagtataaagaactggaaagagaaaatgggaaagacaaactgtgtttaagaagtgcatagtctaatgcttgaactctgactttaaaagattaaggttttccttctttgtcattttgtaagaatcctcagtctgaaaatatgaaagaatggttcttaaacttggtgtaccttagaagcagctgtgaagattacaggaactacctcctggtctccaatcccaggagatttagttggtgtgagccctagaatctgcattttttaaatataagcaccccaggtgattccattacatgtgggctgcagatcacagtttaaaaaaacagtgttctataacattgaatcaaaactaaaactacatttaaggaccttgaatcaaaaagtatgtcattccattaatatttgtataaaaattttaaaatattccttgggaaaagtccctagctacatgcttttgatccccaagattaaaataaagctatcacttcacaattatttactagaagcatttaaaaaataaacaggtagaaggtggagtaagatggtagaatagaattctccagcaatggtgtctctgaaggaacatcaaattgaacaactatctatgtaagaaaacaatttcacaaaggctaatcaggtgagagatcatagcagctggttttaacatgataacaagaaaagatgcattgaagaagggaggacggacacttttccattgcctatgacacctctcccccaaccacaggaaatgcatctccgagagagaatctaatggcttggggacaaggaggaaagtgtgggactttatattgaaacttagtaccagtcttgccatagtgacacatggcactggacaaaaccccacagcacttgattccaggctggtgcccacaaaagaagcatttagacccactctgggccacaagggaatcagatgccccagcaggaagaacccaccaaagttctggccggctttatctctggaaatttattgggctacaaataaatttcagtggcagccaggctgtagttcagaggtgacagcatgctggcagccctcacagccctcgctcactctcggtgcctcctcggcctcggtgcccattctggccgcacttgaggagcccttcggcccgccactacaccacgggagcccttctctgggctggctgaggcaggagccggctccgtcggcttgtggggaggtgtgaagggagaggcatgggtggaaaccgggctgtgtgagacacttgggggttagctggagttccgggtgggcatgggcttggcggccccgcaatcggagcgggacttagcaccctgggcagcagctgcggagggtgcgccgggtgccccagcagtgctggcccaccagtgctgtgctcgatttctccctgggccttagctgcctccctgcggggcagggctccggacctgcagcccgccatgcctcagtcccccacagtgggctcctgcacggcctgagcctccccaaggagcgccgcctcctgctccatggctccaggtcccatcaaccgcccaagggctgaggagtgcgggtgcatggcgtgggactggcaggcagctccacctgcggccctggtgcgagatccactgggcgaagccagctgggctcctcagtctagtggggacttgggagaaactttatgtctagctaagggattatgaatacaccagtcagcactctgtatctagctcaaggtttgtaaatgcaccaatcagcatcctgtgtctagctcagggtttgtggatgcactctgtatctagctaatctggtggggacttggagaatctttatgtctagctaagggattgtgaatgcaccaattggcactctgtatctagctcaaggtttgtaaatgcaccaatcagcactctgtgtctagctcagggtttgtaaatacaccaatcaacactctgtatctagcttatctagtggggacgtggataacttttgtgtctagctcagggattgtaaaggcaccagtcagcaccctgtcaaaacaaaccaatcagctctctgtaaaacagaccaattggttctctgtaaaatggaccaatcagcaggatgtgggtggggccagataagggactaaaagcaggctgcccagccagaagcggcaacctgctcaggtccccttccacgctgtggaaagtttgttcttttgctctttgcaataaatctagctgctgctcactctttcggtccacactgcctttatgagctgtgacactcactgcgaaggtctgcagcttcactcctgagccagtgagaccaccaacccacgagaaggaagaaaccccgaagacatccgaacatcagaaggaaaaaactctggacacgccacctttaagaactgtaatacccaccgtgagggtccgtggcttcattcttgaagtcagtgagaccaagaacccaccaattccagacacatagtgactgcagtccttgggcaagccctgaagctgcataggtctggaagaccctagacttgaggtgtaagccagtacgacagcagcagggcagcagctatgggaatgtctgtatcacccctcctcacactccaggcagtgcagcctgaagagagattccttttgcttgggggaaagaaagggaagtaagctagaggctttacctaggaatgtagagaacaatccctgaacttccccaagtccacagggctggggacctaggaatctataagaattgcagtgtacctgggctttgaatgccctgtagtataagaatggctgcagtgatcactggcttagggaactcgtcagcccactttgaattcctggaaggtcctctgaaggacaggtacaaacaagacctgactgcaaaggctggaataaataccatattctccaatgcccagatattgaccaacatctacagtatcaataacatttaagtcaatatgacctcaacaaatggaccaagtaaggcacccagtgaccaaccctggagaggtggagatgtgtaacctctcagggaattcagaatagctattttgagaaagctcaatgaacttcagggaaacacagagaagcaattcagaaatatatcagaaatttaacaaggatactgaagtaatagaaaaaaatcaaacaaatcctgggctggaaaatgcattagtgggtctcagtagaactgatcaagcagcagaaagaattagtgagcatgaaaacaagctatttgaaaatacagtcagaggagaaaaaagaaaagaagaacgagaaggaacacagaatgcttaagagatctagaagagggcctcaaaagagaaaatcaaagattcattggccttaaagagacggttgagaaggagcaaagagtagaacccttattcaaagaaataatctttttttaaaaaatactttaagttctagggtacatgtgcacaacgtgcaggtttgttacataggtatacatgtgccatgttggtttgctgcacacaccaactcgtcatttacattaggcatttctgctaacgctatccctcccacagccccccaccccacaacaggccccagtgtgtgatgttcccctccctgtgtccatgtgttctcattggtcaattcccacttaagagtgagaatatgcggagtttggttttctgcccttgtgatattttgctgagagtgatggtttccagcttcatctatgtccctgggaaggacacgaactcatcctttttattgctgcatagtattccttggtgtacatgtgccacattttctttatctagtctattactgatggacatttgggttggttccaagtctttgctattgtgaatagtgccacaatgaacataggtatccatgtgtctttatagtagcatgatttataatctttagggtatatacccagtaatgggattgctgggtcaaacggtatttctagttctaggcccttgaggaatcaccacactgtcttccacaccggttgaactaatttatactcccaccaacagtgtaaaagcgttcctatttctccacgtcctctccagcatctgttgtttcctgactttttaatgatcgtcattctaactggcatgagtggtatctcattgtggttttgatttgcattccttaaatgaccagtgatgatgagccttttttcctatgtctgttggctgcataagtgtcttcttttgagaagtgtctgttcatatcctttgcccactttttgatggggttgtttttttcttctaaatttgtttaagttctttctagatgctggatattagccctttgtcagatggatagattgcaaaaattttctcccattccgtaggttgcctgttcactctgatgacagtttcttttgctgtgcagaatctctttagtttaattggatcccatttgtctattttgactttcgttgccattgcttttggtgttttaatcatgaagtctttgcccatgcctgtgtcctgaatggtattgcctaggttttcttctagggtttttatggtgttacatcttacatttaagtctttaatccaccttcagttaatttttgtgtaaggtgtaaggaaggtatccagtttcagctttctacatatggctatccagtttccccagcaccattcattaaatagggaatcctttccccattgcttgtttttgtcaggtttgtcaaagatcagatggttgtagatgtgtggtgttatttctgagggctctgttctgttccattggtctatatctctgttttggtaccagtaccatgctgttttggttactgtagccttgtagtatagtttgaagtcaggtagcatgatgcctccagctttgttcttttggcttaggattgtcttggctatgggagctcttttttggatccatatgaagtttaaagtattttttttccaattctgtgaagaaagtcagtggtagcttgatggggatagcaatgaatctataaattaccttgggtagtatggccattttcatgatattgattcttcctatccatgagcatggaatgttcttccatttgtttgtgtcttcttttatttccttgagcagtggtttgtagttctccttaaagaggttcttcacatcctttgtaagttggattcctagatattttattctctttgaagcaattgtgaatgggagttcactcataattttgctctctgtttgtctgttcttggtgtataggaatgcttgtaatttttgcacattgattttgtatcctgagattttgctgaagttgcttatcagcttaaggagattttgggctgagatgatggggttttctaaatacacaatcatgtcatgtgcaaacagagacaatttgacttcctctttttcctaattgaatacgctttatttctttctcttgcctgattggcctggccagaacttccaatactacattgaataggagtggtgagagagggcattgttgtcttgtgctggttttcaaagggaatgcatccagtttttgccctttcagtatgatattggctgtgggtttgtcataaatagcgcttattattttcagatatattcaatcaatacctagtttattgagagtttttagcatgaaaggctgttgaattttgttgaaggcattttctgcatcatttgagataatcttgcggtttttgtcattggttctgtttatgtgatggattacgtttattgatgtgtgtatgttgaaccagccttgcatcccagggatgaagccaacttgatcatggtggataagctttttgatgtgctgctggattcagtttgccagtattttattgaggattttcacatccatgttcattggggatattggcctaaaattatctttttttgttttgtctctgccaggctttggtatcaggatgatgctgccctcacaaaatgagttagggaggattccttctttttctattgattggaatactttcagaaggaatggttccagctcctctttgtacctctggtagaatttggctgtgaatctatctggtcctggaatgtttttgcttggtaggctattaattattgcctcaattacagaacctgttattggtctattccaggatttgagttcttcctggtttagtcttgtgagggtgtatgagtccaggaatttatccatttcttctaggttttctagtttttttgcatagaggtgtttatagtatcctctgatggtagtttgtatttctgtgggatcagtggtgatatcccctttttcattttttattgcgtctatttgattcttgtctcttttctcctttatgagtcttgctaggggtctattttgttgatcttttcaaaaaaccagctcctggattcatttattttttgaagggttttttgtgtctctatctccttcagttctgctctgatcttagttatttctgttttctgctagcttttgaatgtgtttgctcttgcttctctagttcttttaattgtgatgttagtgtgctgattttagatctttcctgctttctcttgggggcatttagtgctataaatttccctctacacactgcttcaaatgtgtcccagagattctggtatgttgtgtttttgttctcattggttccaaaaaacatctttatttctcccttcatttcgctatttacccagtagtcattcaggagcaggttgttcagtttccatgtagttgtgcagttttgagtgagtttcttaatcctgagttctaatttgattgtgctgtggtctgagagacacattgttgtgatttctattcttttacattcactgaggagtgttttacttccaattatgtggtcaattttagaataagtgtgatgtggtgctgagaagaatttatattctgctgattaggggtggagagttctgtagatgtctattaggtacacttggtccagagctgagttcaagtcctggatatccttgttaagcttctgtctcattgatctgtctaacattgtcagtggggtgttaaaatctcccattatgattgtgtgggagtctaagtctctttttaggtctctaagaacttgctttatgaatctgggtgcttctgtattgggtgcatatatatttaggatagttagctctccttgttgaattgatccctttaccattatgtaatggccttctttgtctcttttgatctttgttttttaaagtctattttatcagagaccaggattgcaacccctgcttttctttttgctttccatttgcttggtagatcttcctccatccctttattttgaggctatgtgtgtctttgcacgtgagatgggtctcctgaatatagcacactgatgggtcttgactctttatccaatttgccagtctgtgccttttaattggggcatttagcccatttacatttcaggttaatattgttatgggtgaatttgatcctgtcattatgatgctagctgtttatttcacccattagttgatgcactttcttcctagcattgatggtctttacaatttggcatgtttttgcagtggctggtactggttgttcctttccatgtttagtgctcccttcaggagctcttgtaaggtaggcctggtggtgacaaaatctcttagcatttgcttgtctgtaaagtatcttatttttccttcatttatgaagtttcgtttggctggatatgaaattctggattgaaaattcttttctttaagaatgttgaatattggcccccactttcttctggcttgtacagtttctgctgagacatccgctgttagtctgatgagcttccctttgtgggtaaccctacatttctctctggctgcccttaacattcttttttttgttgttcatttcaaccttggtgaatctgacaattatgtgtcttggggttgcttttctcaatgagtatctttgtggtgttccctgtatttcctgaatttgaatgttggcctgccttgctaggtttgggaagtactcctgaataatatcctgaagagtgttttctaacttggttccattctcctgatcactttcagatacaccaatcaaatgtggatttggtcttttcatatagtcccatatttcttggaggctttgttcatttctttgtactcttttttcttgaatcttgtcttctggctttatttcattaatttgatcttcaatcactgatatcctttattctgcttgatcgaattggctattgaaacttgtgtatgcttcactaggttcttgtactgtggttttcagctccttcaggtcatttaagctcttctctacactgtttattctagttagccattcatctaaccttttttcaatgttttcagcttccttgcaatggattaaaacatgctcctttagcccagagaagtttgttaataccgaccttctgaagcctacttctgtcaccttgtcaaactcattctccatccagttttgttcccttgctggtgaggatttgtgttcctttggaggagaagaggtattctgatttttggaattttcagcctttctgctctggtttctccccatctttatggttttatctactactttggtctttgatgttggtgacctatcgatggggttttggtgtggatgtcctttttgttgatgttgatgctattcctttctattggttaattttttttctaacaggcaggcccctcagctgcaggtctgttggagtttgctggaggtccactccagaccctgtttgcctgggcgtcaccagcagaggctgcagaatagcaaatattgctgcctgatccttcctctagaagcttcatctcagagggacacccacctgtgtggggtgtctgttggcccctactgggaggtgtctcccagtcaggctatatggtggtcagggacccacttgaggaggctgtctgtctgttatcagagctcgaatgtcatgctgggataaccactgctctcttcagagttgtcaggcaaggatgtttacgtctgtagaagctgtctgctaccttttattcagatatgctttgcccccagaggtggaatctaaagaggcagtatgccttgctgagctgtggtgggctctgcccagttcaagcttccctaccactttgtttacactgtgaccatacaaccacctactcaagcctcagcagtggcagaacccctccccctgccatgcttcagtgtatcaggttgatctcagactgctgcactagcagtaggcaaggctccatgggtgcgggacccaccgagccaggcatgggagggaatctcctggtctgtcagttgtgaagacagtagaaaatgtgcagtatttgggcagaaatgtactgctcctccaggtacagtcactcacagtttcctttggctaggaagaagaaatctgccaatcccttgtgcttcccaggtgaggcaatgccccaccctactttggtttgtcctccatgggttgcacccactgtccaaccagtcccaatgagatgaacctggtacctcagttggaaatgcagaaatcatccatcttcagcttcactctcactggaagctgtagactggagctgttcctattccaccatctttgaagcaaccgtctttttttttttttttttttttttgtatttttggtagtgacagggtttcaccatattgcccaggctgcgtttcaaactcctgaggtcaagccattcattaaaacaaacctatatttgttttatctgagttccttcctcaggaaaggaccctcaggcctctcagaaagcatcatagacctgaaactcagctgatcacagcctctagacaactagatgccagaaccctcactcaacatgagtgcttcctcaccactccctagttcctcttttcccacacacagttacatttcttccctgctatataagcccccaactttagtcaatcagggagatagatttgagactaacctcccatctccgcagccacagcaccgatcaaagccttcttcctcagcaatactcaatgtctcaatgattggctttctgtgtgctgagcagcagggcctacactgaacccctggggttttggtaaaaatacatgtaccctttcaaaaaccgcaattaatgggttgtggcatattgaggaattggaatggcgtcaacttggccgattctgagaaaacacactgtgcttaagtgtcagggccctgcctcctgaccttggcagtttatggttgattttgaggcacagcaggggtgtgtggcctggtttgagtgttttatagaaatgtaaaatatgactgatttatttgtattttaaattcaacaaatctccatttctggtgagaaaatcttgccaaaaccaactaaacaaaggcatagacgtatatgaagaagaaaataaaagactccttgcctcccaatcccacttgcttggtgtcagccattatttattacatggaggaaggggacaaggcacccaggaagtcccaagtcctgttctgacaatcatgtggcctcactggacaaagggaaaagagggaaggcaaaaagaatgtaacactacagtttgcagaaatttccctttggtagaggaaacactggtaagctgagagagtatgttttccaggagggaggcctcaaagggctcttctctggccctaagcccaaactggattttgcctcattttctgaggtgcaaatgaaatgataaaagttgatcaaaggagagggcagagagaaagaaagaggacaactcctctctcgcaggtccaccttccttggtgctgcttgagggatcagaagaaatgccttaacataggtgcatgagaactatggctgctaaatatgaacttagttacctccagttacaagctagtgtgaggttccatggtgtaatggtgagggctttggactctgactacagtgatcagagttcaagtctcagtgggacctttctgtataattccagtgaggttcctctctattgctcccgagtggaatgggggaaattgccgcaatcgtggtcatggaccctccaggccactggctatatgcaattggagtcctggacccagtgacccagcaagacccctcccctctcagggtgaccctgggcttccaggtcagaggtctcctccactaaaaaggctgccttccctcaatcctagaccccgagttttcttttactcatgtcatcgggccgctgccctgtgtctctttggaagaaattacctacgtgaaaaactttactttcaggattccctaattccttcatcccataggatggtgaagtttttaattcctgatattgggtcaagttctaatgcgcacattgctttttgttttcatgggatcccttccaaccagctaccagtggatttctgtcttggggtctctgtggatggcaactagatgctgctcttgtctgaactcctgacacctctctgcagggaattgcctcccttagcctcctaaatcagtcaacatttagatttgagcctggaatcccagcatctgtggagaacagaggttcctgatccctggccagctctccctcagtgaaggggggaggaagagagcagctgtaaggtgcaagtctggggccctgggcaacccccttcttcctgcccagactctgctccaaggagaagttgccttaggaccagatcagatggaaactcttttgttctcttctcatcaacagaaaaatttagacaagaactctggaggaccttcctagcttatacaaatggtgtggccaaatctctccagttttggaaatgtccaagtttaccaagtgttttgagggctcactttggagcctctgaaaaggaggggtgagggcccacggaaggtacctgagggatgcaggggagagaggggaaaaagcagacagaagggaggagagaaggagggagggggagaaagggtgtgtgagggccaggagccaggattcaccctgacagttcagtgactgctccctgcccccaaggttcccactgtggcaccttccagcaggtggtttccatctcttattgatatcctaagaacttggtcctacggaacagtcccaccctatttgtctggcatgagtcctggcagtttcttttcatcttttgggggatcagatgggggtatataggtttgcaagtgacaaggagctaagtcaggaccttgtgaagctgctcagagttaactgtcaagcagcctcctttcccccttcccctgaaggatgattgcctgcaagacagggcctggaggaggccagggcacccaaggccacagaaatgccctgggatgagtcccggcaggagatgccttggctgagctgactgtgcacttccagggctcacaggggtctggccaggagactgagcaaggggaccagggaggttatgcagaggcttctgcacagcaaagcagacattcttcttggagcccccaacccaaatcaggtcttccacctcctcttcctaaagaccctttactgcagctattcttttactagaactacaagtttataggacatagatttcagtgccctcatctggccaaccatcttcagctgccaatgcccagggtaacctccctccctaccaagacctgactcaggaccttaccttaaggagaagatgtcctgttctttctttcccacaagaactgccctagctcagaccccatttctgtctggtgaccaggacagtcccctcaccagtctcgcaggttggggagggcagattctcctcagctccctgcccctgagagaccccaagagtcttgtgtggctccagcccacagagggatatccatggcccatatctctcaaaactctcccctcccactctgaatccaccctctactgcatgctcccctcacagaacagacactttttttttgttttttgtttttttttggcctatcctttttttgcctacccgcatcccagattgacttttctgtcttagaactacctttccctctttggacagtgtttttctggtatacacatgaagatgtcccactctcccctgctcaagaagagagtgcctgacctaagctgggcccatcagatccagtacttacctggaataggaaaaagacggggagggtgaccaaagattacaaaaatctctgaagcttatccacttgagaaagagtccctgaagatactggcctttcattcctgctatgtatatccaatgtgactgaactctgaataaaatatacaagttataacaatgtagtaattgacccagcaaactaggacataaacatgttagagggtaaggtagtgagaggcatgtttgggggtggtggtgatgagcaagtatgtgaaggagagatagtgcctaaacttgaaaatcaaaaagtaataatatatatttagacataaggagataaataactaataattgtttctatgtgatgaaactctgggagtatacaaagggactgctgttgtactaaacaaattttctagtataaataactttgacaaagtatccaaataaaaaaatcctttctcatatatgtatgtgtgtgtgtgtatatatatatatatatatacacacacacacacacacacacatatttgcattctttgcattttgaatataaatttttatacagtcatgttaatccctcttttcttttaaggatttgagtttgatgtcatgcatacaatgtgatcccactgtatgactacagaaatgttagcaaagtaagttcagaagacatggtaggaaaatacttcccagttttggccagaagatggagaaaaaaagaattctcataaaatgttaaaagtatgacttgttatatcttcttttcacagtaatttagacagaaattagcaaaatcagaaaggtatacatactttggtctgacagttccatctccaggtgtctacggagaaatagacaagcgatgcatgacagatacatgtgtcagtctggtccctgcagttgtatttgtaataatacacattggagcaatttcatggccattggttacagaatgtttgaagaatgatccattcatatcaagaaggatatttcgaagatctaagcctgatggaaatgctggaggccatgacactgataggagctcatgcgtgttgaccaattactacgtgacaggcattggctccacgctcatttaaattttggacaacctacgtgttctgatttagcctattggacagcaaatttgacagaaatggaggcacagaaaattaatgtgtttaacttcaaactctggtagattaggtttttcacccagagcctgtggcttcaccatagttgtgattcaggttctgtcattttccacttcaggaatttccagtattccaaatatgagaagctgagaaaacaaacaaaccaactcaaaaccctaaaagccaggataagtaagggtagatgtttgttgggtgtggattaaaaatggacttttttttgcctcaaacaacaaagaggcacgtcggaaaatagacaagagacaagaagaagagatttaagagatatttggtccaaggaagagactcttcagatggaaggtcatgtcagctagaaacattaatgtgactggatgggctcaaaccactgacttttcagtcaacatctgacagcactaacctaatgtttcagagacactgcttgttaaacagtgaaagctgttgctcaattgtgtcatccataattgtcaaatattgccatttagtagcataaggaagtattctctgttgccaggctagagtacccgtaactcttctgttttgttgaacattcttccccaccacaaaccctctttagaagactgggggctcctaaaacattgaggctaagagtcctgtccttgtgcatgtttgggcattgacccagggccaaatcagtggtagactcctccatgcatatgccaggtccccaggtgacaactgcagtctctggatctgaggtcatccactttcccattcctagctcacctcgcccattgtgaagcctggttagtattgccagagacccgagtggacaggtgcccccaccaaagacagaacctgccatgtgcccatcttgctgatccctccatccttctagacaaaggcttcatgagccagggaccttgggtttgctcacaagacagcccctcacctagtatgcattagctcattatgtgtatgtatgtgtatatgtatatgtatatgtatatgtatatgtatatgtatatgtatatgtatatgtatatatgtgtatgtgtgtatgtatatgtcctcaggttgtattccttaaatatatatatgtaattccttaaatatataattttaatatgaaattttaaaaaggttcctttaataaacatttacaataacatcaagaaatataaactatatagcaaagatgtgaaagccagccaggctctcaatagcatcaagaaatataaactacataggaaagacatgaaagccagccaggcttggcttcaaatcccaacactttggaaggctgtggcaggatggtcacttgagctcagaagcttgaaactatcctaggcaacatagtgagaactcatttgtattgaaaatcagaaaaattatcccggtgtggtggtgtgagcctgtagtcccaggaactcagtggatgaggccctaggatgtcataggcctgagaattccatgctacagtgagctgtgatcatgccactgtactccagcctgagtgagtaagatcgtgtctagaaacaaaagaagaaaaagaaaagatgtgaaagcctatatattgaagactaccaagtattgctgagagcagttaaagacatttggaatagagaatgctccttcttacatttcaagattgcttttgttttggggggacacttgctattttttgagaatatgaagttcttcttaggcattcctgtaaaaaaggccactttttgataggattgtattgaatctgtggattgcttttagttgtatttttatcttaaccatgttacaacttccaacccatggacacaagatatctttccatttatttagctcttccttaatctccatgagcagtgttctgtagctgtctgtgtacaagtactgcacctccttgataaaaattattcccaggcttattatccttacaggtgctattacaaatgaaattgtgtcaattttcttctcagattgttcattgctaacacaactgattgtttgctgaaagtttgctgaattcacttactaactctagtagtgtgtgtgtgtgtgtgtgtgtgtgtgtgtgtgtggtctctgtgtgcatgtaagtgtgtttacatttgtatgtattatttgggattttctatatataggatcacaccatctgcaaattgagatcattttgttttctgttcaaaaatatttttctcatgtttatttttgaaagataatttggccaagtgtagaactgtagacttcagtttttctttttttaagtactttattgcaaacttcttgtttgtaaagtttcctatgagaaatcttatgccatccttatatttagtgctctgtatgtaacatgttctttccccttttattccttttaagatttcctttttatcactggttttgatggatttgattaaagtgttccttggtgaagttttcttcatgtttcttcttcttagaataatcgtatttctgtaatatttgaagtttatagtttccatggagcttctaaatctttcatccagtatgttttaaatatctttgtttcccttctccactacacgcccttcagggtttccatttatccttataccaggatgtttaacgtttttatgctgatggtctttttatgttttcaagtcatttgttacagtgtgtttcacttatgttagtttcaacttctattccagctagttcaataatcttctcttctgcaatgtttaatccagtgtcttcttccatttcatactgtaaatcatagttcttatctacagaatttaatatttaaaaaatcttcaacctctccatttaattaaaatacaattatactaactgctctaatatccttttcttctatttccaacgtgtgtcaatttcaactagattattagattcttcattgtgtgttaagttttcctgcttctttggctgcttgatattcttttatttttgttttttttttgggaggggggaggatggagtttcactctcattgcccaggctggagtgcaatggtgtgatcttggctcacagcaacctctgcctcccaggtacacaagcgattctcctgtctcagtctcccaagtagctcagattacaggcacgcaccaccatgcccggctaatttttttgatttagtagacatggggtttcaccatgctagtaaggctggtcgtgaactcctgacctcaggtgatccacctggctgcttgatattctaagatttgatgctgcagctttggtgtcaatgctcaaaagtgcccaaagacaccacttgacctcagtgtctatgcacacccaagcttttgcaacaggacaggtagagagggcagagatgagtgtgctacaacatgctggtagagggcacctcaattttgcttggggctttcctatgtttcatagaaaaatgtgttttccttaatttttcccataagaaccaccctacttcatgccctgtctctctgtccaaacaccaggacagtcctctcaccagtctcaaccacccaatggattgacaaatgtccaaatatgattcagtggagaaggcattctcttgtcaacaaattgtgtagaaacaactggacatgcatattcccaaaggaaaaaaattcacctgaacctcaatactgactcaaaaactaactcaaaaaggattatgcaactaaatataaactataaaactagaaaaagtatagcagaaaatgtaagacaaaatcttcatgacacagagttaggcaaggtgttctttgttttcaataaacacaaaccattaaagaaaacattgataacttcaactttataaaaattaaaagtttttgctcaacacaagacagtaataagagaacaaatataagctgcagattgggagaaaaacagtggaaatcacaaatatgacaaacggcatgtgtgatagttacttgtacttgtcactgtgaccgagcaccatggtactgggacatttggccaaacatgattctggttgtgttccagagagtgtttcggatacaattaacattgggatgggcagactaagtgaagcagattgccctccttaatgggggtgggactcatacgtacaatcaaatgccaggagacaattaagaggcctaatggaaaacaaatgctttcctgggtatccagctttccttccatcttcggaatttcagcctctataacctcagaagcaaattcatatatatatatatatatatatatatacacacacacatatacatttcatagttatgtggctaagattgtatttttaaaagttcagccatgagatgattggtgaagccagtcaatgaataagggtgtgttctattatatgattcagtcttcttttgtacacgatttaagttctgcatttgaagtaggaggatgggagagagtaagtccacctaggatgataacagttgaatttctcaacatacacttcaaagccctagaggttaacttagagagtcaaaaattccacccataatcctgcccctacacactagggctagggaacactgtggctctcaggtgattttatttagccaggtctgggagccacacaacagcagacggagcaggaaacactatgcaaatagaggccaggacagcagggagagcctgttaatgacagaacacaggtaaaactatcctcagaagcaagtgtggagaaacacagatgatgcctgagacctggtggattaaagcactggctactggggaattgaaaggaaggggcttcaccatgcagaggaccagaagtgccaatcttggaaacgcagaattcctgggagatggggaggcgtggaccatggaagtatcctctggagactcgtggtgaagagaacaaatgaatgaagtaactggcagaaattagagttcctggtagaacaaaatacaatcccacaatgagaacatacaccatgtatgtcccccaaggaagacaatgtctcctaaaaactcaagaaaatcattttgggcaagcaccttatatccagtaatgcgatccatgttttaagactgtgagaaaagattattaaacatgctaaactcagtgagatccaattccctcaggaggactctgttaaggatgagtaccactcagcaagtgatgactgtgacattcacttttggacagctcatgagcattaatatatttaattgtggatctaaactaaaaaccaaggtggagacaagatgacaatcacagaatgtcactggtatatgtttagcttcaaatactattatgagaagtaacaggtaaaggaggtgggaaaaagaaaacacattatgtaactgactgtcatatggaaatatttgatgctgaaagttataatttaaaacgtataaaccaaatattagaagtgtgtctagttcaaaggggggaaaccatcaaaaacatttttagtgcaatatttagcatgagctctacaacgcttcctaaatgtcagaggcacacacagacacacacacacactcactcacaaagaatacaaataattggaacccagaaaagtagtaaatacattctgctacatatggtaaacatagcctacaatgtggaagagattagaaaataaacagggaaatgaaaatgtttttattaattcgcatcagtatccatgaaaaatagtcagcataataaaagattataacactgaatgtaaaaaacaatccagcagttcagagtgataggcaaaagtttttaattgtatagattcaaattaactttggacaaaagttaaaactcaggcagagaatttttttttcaacaacagacactaacaaaaacaaaggcacagtaaaaattgagacagaaaatttgcagtgtagaggtatgaatctaatgatagacacaggcatggatgattaataaatgataaaatgtttagaggatgatcactagaatacaggacatttatacttttaaaaaccactttcccaaatacttcattataagtaagttgtctctaaaagggacagatcttctagacccctccttaaccaagtaactagtcctgatgtcatgataatggtgatggacaaactagaccttctctgcgcgcagatgggctgaggttggaagctcacagcattgactctgcagtgttcctggcaaaacgtttaggctgaatttaatcatgaagacattttcaggcaacttcagaatatagatcattgaaccagacagctgacctgtcctctacaaacaagtccatatcaccacaatcaatgacaacaacaaaaagatgaggaaatatttggggttcaaaataactaaagaaatgtagctacattatctttttacgtttttttgaacccaaaatgtctcttctcctttttgttgagtgattcgtggtgacatggactgtgtgaaggagacaggtcagctgtcctgctcagtgctctacattatgcagttgtctggtgattaacctaatatgaaactcaggccaagcactttctgcaagaacatggcattgttcacattctgcaccggcagattccgaggtgacatgctgtctcctgccagtggctcctgactcctgttctctacaggataagaattgagaggagcatggctacagcctctcaatgctgtttgtccatctagatgtggtcttcctaagtattgatatcaattggaggctgaaggactgtagcttctgtcaccaaaggagcctagtgggttacaattgtcaagagcagtcagtggttctgaaatacaattctcagcgaaggatccctcctgggttacagatggatcagctaaaacaaaccaacactgaagatacaaagaatggggttaggttcactgaaactagggtaacacctttgcatgagctaaacacaaagatgacactgaccttgagcaggcatagaaggtcagagacatgcctgcaaaatgaaatccctgcggaactttgtagctacccagagatatgtggttcaatttagaatgtctgacagatcactcctggcatgtgctgcatagttatgtgaacgtgtcacacctaactttggtccaatgtcttcagacttagcacaggttgccactggcatggtctgagaataggaatagagccatgcccactgacccatcctatgcctgggcttcgaaatggaactatagtttcattcaaacctacatgtgcctataggtcctgcctgcagcaatgacatctctcagtttagtaagggctgcttagtgtgggaatatgactcccatctggaagaccaggtggagacttatcaccatcaaagtaaaaaacctattgtccacttcaagggcaaagctgctgtgctgttccttaaatgagtaaaaggcacttctgtagtgctggaatgagtcaggcagttcaaagtaagttggaggagtcgaataacatctatccagtgaatcctgcaagacttcaggctcttccacttccatcagcaccccgttgagcctgggaaaggagactaaactaaagaagtagccagggaaaatcagacaccacagagccccaactagatttccggggtaaaataaggaagtggttaaaaaagaaaaaggatagatccattaatgaggcaaaaaattattgcctttatgttgggatagaacagggccaggtagaaaacaatgaaagagaaagacagagagagagacagacagacagagagagagagaggagagaaagtgagctcagtgaattggccaggtgacacactgataaaggagtaaaaagacattttgagttagtgccctcatgacacacagcaaaagagtgagctcttcagttttccataaaacttgctcaaaattcgatgcagtcaccatgaaagtacagcttttgaggtacagtcaacccatggtacattagtaaatgataaggggaggaagaaatgaaaacctaaatgtctactacaatgaaaaccaacagcaatgtcagtaggagtgattcagccttcgttgaaaacatgaaattaaacacaccctgttttccctggatctgtcatctccaggtgttaacacagaattaagcatctacaattgctgaaagttacctggggcatggtgggttctgatcttcttccccttcttggtacttttcaatttctgaaataaattcagacatggacagacacaataagctgattcccctacacacataacaatccactgtctaatcctcaaacagggacctcaggctcctcagtataagaataggacactgtgggagatatatttcaggaggcctgaaggctgctcatgatagagattccttggtttttgtcccagaaactaagggtaaaatgtccctattctggtagattgttatcccaatatcatttgtcccaagtttgtgcaaatggttatgccatatttttccgatcaatttaaagcaaatgccctcaaatgatttctaggagaaaaactgcaataatcagccctgtttcatcaaatactcaggttgttcatggttgtgaggattttgactgaaaaaggaaaactacaaacccttgagtcgaaatcatagttctctgaatttgtcacatctgcccaggtccaatgtcttgagagtagaatctgagtgccacaggcatggcctgagatgaggaagagagccacgctcactgacccatctcatgtctgggcttccaggtagaactagagtttcattcaacctatgtgcctataggtcctcactgcagcaatgacatctctcagctcagcaaaggccaattggagcaggaatatgatctctatatggaagactcagtggatccttattgccttcatagaaagatactcaccatccacatcaagagaaaagccaacgtgttgttcctccaatgaggaaaaggaacttccatagggctggcatgagtcaggcagttcaagataactggaaggagtcaaataacatctatccagtgagtcctgcaaaacttcagactctactacctccagcagctctctgctgcgcctgcaaaagtagaaaaagtaaaggataagccaggggaaatcagacacaacacagccccaactagatgtcatgggtagcataaggaagtggttaaaaaagaaaaaggatagatccattaatgaggtaacaaattattgccttcatgttgggtcagaacagggccaaatggaaaagaatgaaagagaaagacagacagagagatagacacagagaaagagagagagagagctcagtgaattgtccaggtgacacactgatgagggagtaacaggacactctgagttagtgccctcagaacacacagcatacagtgatcatgaaaagactgtgctcaataattttccataaaatgtgatcaagattccatgcagttgccataagaatacaacttttgaagtctggtcaacctacagtaggttagtaaatgataaggggaggaagaaatggaaacttaaacatctactgtaatgaaaaccaacagcaatgtcagtaggagtaattcaaccttcgttgaaaacatgaaatcgaacacactcttgttttccctggacctgtcgtctccgggtgtcaacacagaattaagcatctataattgctcaaagttacctggggcatgatgggttttggtcttcttctacttcttggtacttttcaatttctgtaataagttcagatatggacagacacattaagctgattcccctacacacataacaatccactgtctaatcctcacacagggacctcaggctcctcagcatgagaataggacactgtgagagatattcttcaggaggtccgaaggctgatcatgatagagattccttggcttttgtcccagaaactgtgggtaaaatgtccctattctggtagattgttatcccaatgtcatttgtcccaagtttgtgcaaatgattatgccgtatttttccaatcaatttaaagcaaatgcccccaactggtttctaggagaaaaactgcactattcagccctgtctcatcaaatattcagattgttcatggttgtgaggatattagacactgaaattagagtgaaggaggaaatctacaaaactgagacaaaatcagagttgtgtgaatttgtcacatctgcccgaatccaatgtattgagagtaagatcagggtgccacaagcatggcctgagactacaaagagagccacgctcactgatccatcccgtgtctgggcttccaagtagaactagagtttcatttaaatctacatgtgcttataggtcctccctgtggcaatgatatctctcagctcagtaatggccactagcagcaggaatatgaccctatccagaagactcagtggatccttatcaccttcatagaaaggtactcaccacccacatcaagagccaagctaacatgctgttgctccaatgagtaaaatgcacttctgtagggctggcatgagtcaggcagttcaagataactagaaggagtcaaatatctatccagtgagtcctgcaagacttcaggctcttccccttccagcagctccctgctgagcctagaagagtagaaaaagtaaagaataagccagggaaaatcagaaacctcagagccccagctagatttcatgggtagcataaggaagtggttaaaaaagaaaaaggatagatccattaatgaggtaacaaactattgccttcatgttgggactgaacagggccaaatggaaaaggatgaaagagaaagacagtcagagagagagagagacagctcaatgaattgtccaggtgacacactgatgagggagtaacagaacactctgagttagtgtcctcaggacacacagcatacagtgatcatgaaaagaatgcgctcaataattttccataaaatgtactcaactttccatgcagtcaccatgagaatacagcttttgaaatatggtcgatgtaccgtaggttcataaatgataaggggaggaagaaatggaaacctaaatatctactgcaatgaaaacaaacagcaatgttagtaggaataattcaggcttggttgaaagatgtaatcgatattgtcagcccactctgttttccctgaaccaagagtctccaggtgtcaacacagaagtagctgttcacaattgttcaaagttacctagggcatgatgggccttggtcttcttcctcttcttggtcctttttaattcctacaataaattcagacagggacagacaaaataagccaattcacctacacccataacagtccactgtctaatccccacatgaggacttcaggctcctcagcatgagaacaggacaatgagagagatatacttcaggaggcctgaaagcaggtcatgatagagattctttagttgcatctcagaaccaagggtgaaataccactattctggtagatcgttatcctaaaatcatttatcccaagattgtggaaacagttatgccttattgttcccatcaattcaaagaaaatgccccagatgatttctaggaggaagactgcagtattcagccctgtctcctcaaatgcccagctcgttcatggttgcaagatactgaaactagaatgaaggaggaaatctacaaacccttgagtccaaataatagttctgtgaatttttcacatctgcctgggtccaatgtgctgagagtgggctgaggtggtcacaggcatggctggagactaggaatagagccatgctcactgacccatttcatgtctgggcttccaactgaaactacagtctcattacaagctatatgcacccacaggtcctgcctgtggcaatgacacctctcgggtcagtaagggccacttggaacaggaatatcacccctatctggaagaccaggtggaggcttatcactttcatagtaaggtactcactatccacatcaagagccaagccaaggtgctgttcctccaatgagtaaaaggcacttatgtagagctggcatgagtcagacagttcaagataaccagaaggagttgaataacatctatccagtgagtcccgcaagacttcaggctccttcttgtccagcagctccctgctgagcctggaaaagtaggaaaaagtaaagaataaggcaggggaaatcagaaaccacacagccccagctagatttcatgggtaacataaggaagtgttttaaaagaaaaagaacggatccagtaatgaggtaacaaattattgcctttatgttgggatagaccagggtcaggtataaacggatgaaagaggaagagagagacacacacacacgcacacacatgcacacacacacgcacacacagagacagagagatagtgagctcagtgaattggccaggtgacacactgatgagggaatcaaaggacactctgtatttgtgctgtcaggacacacagcaaacagtgatcatgaaaagagtggtcttaataactttgcacaaaatgtgctcaagtttccctgcagtcactatgagaatacagcttttgaggtatggtcaaccttcactaggttagtaaatgataaggtaggaagaaatgaaaacctaaacatttaatgtaatgagaaccaaaagcaatgttagtaggcataattcagacttgtctgacaagatgaaatcattattttcagcatgtactcttttccctggacttggcgtctccaggtgtcaacaccaaattaactgtccacaatttctcagactcatctgggatctgttgcctcttggtcctcctttttcacttgatcacatcgatgtcctgcatgcaaataaattcaaatggggcctcttacattaagcagttcttccttgcacacagaaaccttcctctgtccaatccgaacacagggacatcagtcttctcagtgtgagaacaggagactttgagagaagtataccaggaggcctgaggttaagtcttgagagaactgacttggttcctttcttgagctttcggcaaaattcccctgttttggaacgttatcttcccaatatgctctgtcctaggtttgtgtacacaaatgagcaatatttctcccaatagagtttaagcaaatagttctaacaccttgtaggagagatactgcaatattcaggcttctctcataaaatacccaggatttgatagcttacgagattgtggacactgagatttgatggaggggtgcaatgtaccagctcttgagtcaaaatgagacttggttcgacacggaagcatcagctactatggcttttttgggtaaaaagtcagccatttatctagaaaacatgccagcaagatgatggacagatgagctaaaacaagccaacttagaagacacagaaaatggggataaattcagtgaaacctgggtcacattttccactgagaggtagacaagggtaatactggccttaggcaggtaaagaactgcacagacatgctttgggaacaaaactcataacgaacttcgtagctggcaagagacatttaattcagatgagctgatctgacagacaactcctgggcatgtgctgcatagcttggtgtgagtttgccacaccagccttgagttcaatgtcctgacagttgaaccagcgtgccacgggcatggcctgagactaggagaaagccaagctcactgacccaccccatgcctgtgcttcagactcgactccagagtgattgaaatctacattgatatataggttcagcccacagtgatggcaactctcagcccaaccaggggcacaaggcccggagattatggggtctacctgggacacgaacgggagctttatcaccttcacaatggagtattcactgcctatgacaagagccaagccgacttgctgttcctctaatgagtgaaaggtgctcctgtaagactggtacgaggctgacttgtcaggaggaattgagagagtcgaataaccttcatcccaggactcctgaggggcttcctcctcttcagactcctgcagattcctgacgaggcaggcaggacagggatgacagaagatttaaccaacagagattagacaacaaaacctcccagatgttctgatgggagacagaatggagtggtcacagaaaccaaaggcatttttccttcaagagaaataaaattatccttctaaatgcaaggtagagggtgtctgctctggggacagagcaaaaatgggcagcacgtgctcagtacatttgccacagatgagccaatgtagggcaccaagactctccctgtaaactaccatcatgacttgcagcacagagaactaacactgggcttcaactactttgcataaattaaattgaattttacatgcagcattcaagtgaacagagctcttgaggcagtgcagacacagatcttgggtattaagggccccatttttccaatattttgatataatacgtttattttttcaatttcttttcttgcacaaatactagcaaacatactaacaaaaaatgggcagaaagcatatatacatctctccctggatttaaacacatgggagagaacaggcaacaccaagaaatccctgtttgagggtctagagtagactcccaggaaactccaacagacctgcagctgagggacctgactgttagaaggaaaactaacaaacagaaaggaatagtatcaacatcaacaaaaagaacacccacaccaaaaccccatctgtaggtcaccatcatcaaagaccaaaggtagataaaatgacaaagatctggagaaaccagagcagaaaagctgaaaattctaaaaaccagagcgccacttctcctccaaaggattgcagctccttgccagcaatggaacaaagcaggatggagaatgactttgactagtgacagaagtaggattcaaaaagtcagtaataacaaacctctctgagctaaaggaggatgtgcgaacgcattgcaaggtagttaaaaccttgaaaaaaaaattagacagatggctaactagaataaactgtgtagagaagaccttaaatgacttgatggagctggtcatcaaaccatagcatgagaactacgtgatgcatgcacaggatcggtagccaattcgatgaagtggaagaaagggcatcagtgattgaagatcaaattaatgaaatgaaatgagaagagaattttagagaaaaaaagagtaaaaagaaatgaacaaaacctccaagaaatatgggactatgtgaaaagaccaaatctatgtttgattggtatacctgaaagtgacagggagaatggaaccaagctggaaaacacttttcaggatattatccaggagaacttctccaacctagcaaggcaggccaacattcaaattcaggaaaaacagagaaaaccacaaagatactcctcgagaaaagcaactccaagacacataattgtcagattcaccaaagttgaaatgaaggaaaaaatgttaagggcagccagagagaaaggtcgggttacccacaaaggaagcccatcagactaacagcagatctcttggcagaaaccctacaagctagaagagagtaagaggccaatattcaacattcttaaagaaaagaattttcaacccagaatttcatatccagccaaaggaagcttcataagtgaaggagaaataaaatcctttacagacaagcaaatgctgagagattttgtcaccaccaggcctgccttacaagagctcctgaaggaagtactaaacatggaaaagaacaaccagtaccagccactgcaaaaacatgacaaattgtaaagaccatcaatgctaggaagaaagtgcatcaactaacaggcaaaataaccagctaacatcaaaatgacaggatcagattcacacataacaatattaacctgaaatgtaaatgggctaaatgccccaattaaaaaacacagactggcaaattggataaagagtcaagacccatcagtgtgctgtattcaggagacccatcgcatgtgcaaagacacacataggctgaaaataaaaggatggaggaagatctaccaagcaaatagaaagcaaagaaaagcaggggttgcaatcctagtctctgataaaacagactttaaaccaacaaagatcaaaagagacaaagaaggccattacataatggcaaagggatcaattcaacaagaagagctaactatcctaaatacatatgtacccaatacaggagcacccagattcataaagcgagttcttagagacctaaaaagagacttagactcccatacaatcataatgggagactttaacaccccactgtcaatattagacagatcaatgagacagaagcttaaaaaagatatccaggacttgaactcagctccgcaccaagcagacctaattgacacctacagaattctccaccccacatcaacagaatatacattcttctcagcacaacatcacacttattccaaaattgaccacatagatggaagtaaagcactcttcagcaaatgtaaaagaatagaaatcataacaaactgtctctcagaccacagtgcaatcaaattagaactcaggattaagaaactcactcaaaactgtgcaactacatggaaactgaacaatcagctcctgaatgactactgggtaaataacgaaatgaaggtggaaacaaagatgttctttgaaaccaatgagaacaaagacacaacgtatcagaatctctgggacacatttaaagcagtgtgtagagggaaatgtatcgcactaaatgcccataagagaaagcaggaaagatctaaaatcgacaccctaacatcacaattaaaagaactagagaagcaagggcaaacaaattcaaaaactagcagaagacaagaaataactaagatcagagcagaactgaaggtgatagaggcacaaaaaacccttcaaaaaaatcagtgaatccaggagcttgttttgtgaaaagatcagcaagaaattcctgtttagctagttcacctggctcatctgattgcaagttcctatcttgacaggactacaaaattaaaaccaatacaagggccacaaataatgcacaacattgttaataaggacaatttgtagttgggtgaaaagaagaaatagttctatacatcacttcccctttttccctaaatctacaatctcctggtgtcactattgaattaacagcccacaattccatagcattacctgggaaacactggccctttttcttcctcttcctcttcctcatcatcactttcattttctgtaaataaattcagagaagcaggtcacattaagcaattcacacttcacatatgaccaaatcagtgttcagtcatagcacaaggacataactattctcagtgcaagaatatggattctgataggaatattctagggtgccctagattaagtctgatgagaagtagatgaccctgctttccagacccacaggccaaaatctccctctatgagtagaccataatgccatattccctgcctgagtctatgcaaagttaaacaaaatttttcccaaaaaaatctccaaaaattgctcaaacaattttctaggagtgttgctgcaatactgacttatatccccaggtaacacggacattaaatgtttagaggcatctatacatgaaacttgactgatagataaatttgaacagctcttgctttaaaaaggatctgtgatttgggaggctgaggcaggtgaatcatttgaggtcatgagttcaagaccagcctggccaatatgggaaaaccccatctctactaaaaatacaaaaactagccatatgtggtggtgtgcacctgcggtcccagctactcaggaggctgaggcaggagaatcacttgaatctgggaggcggagtttgcaccaagccaagatggtgccactgcactccagcctgggtgacagagtaagactccaacgcaaaaaaaaaaaaaaaaataataataataataataatctatgatgctacaaagaaacattggatcagccattgcattgatggggtggagaaccagggtccagccttgctttatggaaatatatcagcaaagtaaagaagaaagtttccttcccgatttcaaggtgactgtgcaaagtagctaggtaagctgacttaaaggagatcgagattaaagctgagagcagtgaagcctggggaacaatatttccaaatacacaggaaaagctgccagcttcctttaaaaggcatagaaactccatggacattgtttagggacagatggcctaatcacaggggacaagagatactgagtcaaagctaggaggcctgacagatacttcctgtgcacctcctgcactcaggtgactatgagattgtcacacttgcttggggtccagtaacttgatactggggactggcagacaaaggcatgacatgagatgagaaggacacacaaactccctgatatctgtgtttagaatccaatcgtagttttttattcaaaccaatttgtgtatatagagcctgtcttcagagtttatcttcctcagcctagaaagaggtatgagacacaaggaaaatagaggctacctgggataatgtgtacagcatcctctcattcatcatgagaggatgagtcaatgagagttggatcgactttatcttcctcaaatgtgattttggtgttcctgtgaggctggttggagtcacaagggccgtggctatttgaacaagtgacggcacgttcctccagtgagtcctcagggacttccttttcttcagccttctgcacctccctgatgagccaggtgggatcgagatgacagaagattaaacacagagagattggaccccagggagtcctagctggttttgacaggaggcatgagagtggtcccagaaagcaaccaggaggttccctttaagagggaacaggcaatcctcttctctctgcaagagaacatggccgccaaaggagccagagaggaagagagcagctggtgttcattgcactggacagataggagctgaggtggatgaagactcagctatccctgtatggtacagacatgacacttggcacacatagagaaacacgacagatgccacactctgtgtctcagctgggttgaatttcacatactgtggccaagggaatgcaggcttttggcccactgtagatgccagagagggtgtgccttttaaacctttttcatgtgttaccacccattacttactcctgagtattcagtgttacctgggggcacatgattcctgtactttctcagcctcctcaacttcaacatctttatcctcatcttcatcattttctgtaaatacagaagtgtttgttcagctatttcccacttcacactctgcaagacagtcagcccaatgtacacagagacatgaacatctagtcatgggttaccgttaaactgaaagctctcatgttttgtctttaacaaaatgccctggaacggttttctgatccatcaggcaatgcatttctgatctggagggccaccatcaagatgtggccaaatactgaaaagactttttgctccccatatcactggaggcttgtgcagcctctctctggactttggcaactgtctcccccatcccatcacagatctgattcccaggcacaggcttggtgtcttgtcacagttcgcattttgaacctaattctttctcttaggagaggacaagcttgtcccacagtgctctatgaatcaggagacttcacaggccctccatgtggcttctgctgtgtgacattctctccatggggagtgctccagtctgaagcacttcttaccaccaaaagcccctacatcaagtgccttctccaacatgacaaggcgaggagcttcatctcattttgaaaagcagtagtaagtgttcccacatttggatacttcagtcccttgcaagaaacaatctgtctgcctttgcagatggtgagagacaaactcaggaaggataaatcactcacttaccgacagttactaagaacattgctgaagaaacagcatgggaaccttcattcttagtccagagctcttttcactctaacaagcgccctccagtcacagcctccttcctgtcctttaaaactagacagatgctgcctcttgctccaaagatcaccttccatcaaggaagaagggacacttgcaatactgtgacctccaaccccatgggtttcccatctctgttcttacccaggaagtcctggtcatgtcatggccacatatgtttagtggaaaaaaacaccaccgatacaactgtcattgaaagtatggaggtctggagtctctcataagcctggggttttgggtcatcagggcctacggtcaccttacctgggctgagcttttggacaaggtgctgtgccagcctacacccctcagccagctgttcttggaggtcctgcccctaggacttgtcccactcatccagagtgaggagggcctggagatgctgattcaatgagtgggaggcatctctcccttcctgtaacttctcctgtaactgggtcagctctcattcctgagagtggactgggactttatatcacctaaggttagatagtagagaaaatttaacagtggaactggatgagtgatcagttctaatattatgacagatttctgagagaatgtcctcaaggagacctccacgcagaaggtcaacatacgtttaaagaaatgtctgtggccaagaaaaagaataaaaaatggtttacaggcttcctctatatcagagagggctcctgtaagatcctcgatgatgttccattcatctttctcttctgtaaacaaaagtaggtgtcttcctaattcagtttcaaaacaacatcccttcagttcctcactctgaccagggaaatctccatgtgaaaatacacatagtgcatcttgcggcgactagatacaaagccatgtacagaaatgaggccaggtgaagatggggagaattgaaaagacaaaagaagtaaagaatgacagggtcgagaaggcaacattgattgagtgaaagaatgagaagcagcagtcaggaggtgattctcacttagggtaagtagggaggtgatggcacaccattttgagtatactgaatgctgctgggttgttcccactcctttggttaattttgtgttattcaaatttcacctcaacaattacttgtttgaaaaagagaaaacaaggctctgagaaacaactgcaacccataatttattattatccttgttctctgtttgataaatatttgtgtgtcaagagccctaccatggcaattcctgcctttcccctggcccagcttagctcttacttctccccaccgagctgctgtacttcagagcctgcctgccccatggggcctgcctgcccccacttgcctgcccccacggggacccctcacctgagctcctcagcttgcctgagctgctctgcaagcttctccttgaactgcagctcattcctcagcaaagattttatgaggtctttgcactcttcacactctgagaaaagacagacacgcctgcctcagtggaaggctggacatgctgctgtggtcactgcccacagggcaggagccaggtccatcccaaggacaaaactgtccccagtaccaggccctaggaagggatttccacatctttattcttcagtctcctgactttctggcatctgatcctccaaaatttagggacgaagaaagagaaactcaagggcacatcaagaaagttgacaagatgattcaaccacaatgaagtggagtcagaattcacagcccctgaggtttgactctgaatgcggggccactttcccaagccttgcagcctctcctctaaaacactgcactggggcatgaagtagtgatttcttgtacagtcaggaaggccccccaggactatgggaatgatggtttcccttttactgggaatttcaaggacaaatatgtcaaagatttttaaatcatatcttcagatatgattttaagaatcatatctgaagcataaagtatgaggcataagaccataaggccatgaagggaatacgcccaaatgctaataaagtttgtgttaatttagaaacagtagaatgaagaagtaattgatagtgtttactctgtgccaataaatgttctaggagattggcaagaaatagctcatgtaattcattgcagcaatttacagaggtaggtattattgtcgtaccctgtgaacagatgaggaaactgaggaacagactgagggacagacaagacaagtaacttggatagagcccaggagacaggcctagggtccctgctctgcacgctgtacttctacttccacacattctcaggtgcgacctttcttcttctttgggagcaagagcctgtgcctcaggaagaaggacttccctctcaacagggtactctctacttttttttaattaattatttatttatttatttatttatttatttatttatttatttcgacgagtcttgccttgtcacccaggctcaagtgcaatggcgtgatcttggctcattgcaacctctgcctcctaggttcaaagaattctcctgcctcagcctcccgagtagcggggattacaggcgccgcaaccacgcccagctaatttttgaatttttagtagagacggggtttctccaacttgcctaggctagtctcaaactcctgacctcgtgatctgcccaagtcagcctccgaaagtgctgggattacaggagtgagccacagtgcatggcccctactccctgctcttgatgctgtcacttatatataccacatgttctattaggagcagactgctcttgaagcccttcagagcgggtactgggtactatcaccaagtttccctcagggtcactagaacagagctttgcctattgggcctcaacagaagcttgaactgaataaaagttcacttgtccagacatttagaacaacagactagatgttatttgtctgcaggatcttatatagtacagagaggattcttgaaaacatgatttagcctcttggagaaaacaggtcattctgtgcctgtgtcagaaatcaataactgggattttaactctagtcccacccccagctgactgctaacatggaaagttgctaaatactttggtacctctgtcttccaaatttaacaaaatgttaaaatacccatttctattttcttagatgtacgggaaggatgaaattatttttgttggagacagcatttagtttctcagagagaagatagggcattattcatcacttttgtgatggtgagcctatagaacttatggtatttgttctgccggttggccaggagtaggccacttgagttacaagaaatttctctttgatgattctgaactgctgtttgttctctgccagctgggggcgcaatttctcattgatttctagaatgttcttttctgccttctcactggatcaagggctggcagacaacaccatgctgacgtttgtggcagaagaggtggagccagggactggggagaagaaacccaaacacatgatgggttaaaaactggtgaaatccaataggtttaatcaggactgagggatgtcagtaactgaaattcttaacttactattgagaaaaatgtgatcactccccacagcactttaggatccttcaccacaaaaacaaggtttgaggtgcctgaactcagagctgaaggcactcactaccagtagctcagactctgacaaaagtaaggaagattgtggccagcgtgccaggtaaccgtctgcagttgcaataacagaattagaagataggggtgtcatggaatcttaggagctctgcgttgcaattgcccaggctttgctgaaactcaggcaccctggtctcacctgagggtcaccaccaatgaagattattccttcagcattcactctcagtattcgtgtacccctgtgacaatgccacagacccatctctttcccaatacatctaagcatattcctcactgtttatctcttgtctgtacaacatcatcaaggcaaacagtttcccaacaggttatattttcttaatcgtagtcatgaagtcaccccacctgctctaagttaaaacagaacttaaggcttttccacaagtctaaggtatcaaacttttagcttgccctgatgtcctctgggtcttctgcagttttttctgtatccactagaaagtgaatgaataatccattttttaaaaatgttttctttcctgtctcggtattcttcttgctgcatcccattgttatgttgattcctttttttcttactggggcaccatcttggcttttcattacactctagacaagtatgacatccctacatccaaaactcttcctctgtgtggggtgatttgttttttaatgtcactgaacactacattttatacttgtcacttatggatgtcattctagtgctacaagagctcttttcaaggtatcaagtgatcaaaatcatttacatagggatctcctgaaaacatgtgtgaccatctatcttgggaatttttgtaaactgatgctattttgttgtttccattttgttttcccatatactgaaaagaacaggaccacgagcagttcttatggaatatggtttgatatattttgttgagttggactaataccattgatttttggttgcattccactaacagaacatgacaagatcaaggttatggtcagggttgcttgctgatcctcactgttgctgtgcagtagaaggtgagtttgaggtgaaaggcgtgagtaggaaagagtgatcccctgaaccacctcctcactttctcagctttcatcccacctaggttttgtgagcctggaacttgggagaatgttctgtagcccaggtctcctaagattggctgctagacttgcctgagttgaggatgcagtgggtgtgaacctgggctgcccagcattcatgtggaagtgaaggaaggaggactggatcaatcccatttgaaagcatccctccctgcagcccgcaccatcctccaatgacactatgaggacactgctttgagatgtatcaaaggctttaagtcaatgtattttctggggtctgggagacctgacattctgtttcagaatgaaaatctgtcaggtttattcattttacaaatgataaaactgcaagttcacaaagttacatggcttacatgaggtcacacaaagatgagttttcagcactgccaataaaagcaatcacaataattattcagtaattattcatagaatccatataattcgtaaacattcacataattatttagtaattattcattgaccaattcatacaaggcattttgctcaaaactgtgctcatatttggacattgtatcttcatcataatccttaaggtaacgctattatccgtaagtaacaggtaagaaacctgaagaagaggaatagcaaatcatgtatttggccatatttccattttttggtttttgtgatgctggaagaatgaccagaatgagtcacgggaagaatattcattcctgtattattctccaggacagaggtgtgctctcctagagtactggggccaaaattcagaagtgtccgcaaccttgctttaacagtatgggaaataacctctatcacctggaatttccctggaactttggaatatacaagagaagtatgagatttgggtcttcctttggctgtgtttaattcactcttctatggaataccaatgattctcactaagacttctgcctttttataaccacaatgtatgttatggagaagattttatactttgctctatttagaaagaataaatatgagcaatggtttaggttttaggtcctggacttaatatttttctgatttctgttttgagattaaattctcatgtaaatagaaaaatacttattatttcttataaggccaagtttgttattagtttgagttttcaaaaatgaagcacaaacttttgattttatctttgtctgtccccatcagcgccactcattgtctatcagtatgacctggacttgcccctgcacttaacctcatcctgctgagccatctccaagcactgtccaattccgtcagtgattctggctcctcccaaggctccctgaaatggatgcagggatcaggacatcagacacattccagacacaaaggcaacccagactgtagagcaggcagctgtgttcccactaccctaatgttccagtgatgtcctaaaactgaaaggaacactttccctttttaggggtctgttcttcatgtctcaatgcctctggtctagttaacacaactgttctgtaagtgaaagaacttgctaaatttctggtttcttgttaggtggctagaataggtttataagacttccttacttacccatgactgctgaagtttgaattcttaacagtatgattctttttcttgtaagatgagcagtttaggaaagataggccatgttgctgtgcaaaaagaggtaaacttaatttctactcaaagcatgcttgaatttgaagctagggcttccattcttccaaagttggactgtcactgcctcaggcatgtgttccgaagggcttgtgtctctgctgtactcaaaataaagtttaaatggagcccagcaagccagatctcctttagttctaggttcccacaacagtttctcctctgctttagagactgcattgaaaatattcttgttctgctgttgtgttttggctttggaatgatgtgatgcagctcagtgggtcctacccccaagttgatcagagtaagaaacacctgggaaagtcagtgcaaatacaagttcattgtcctccttgcagggatttggaatcagagggctcaggtgaggcctggaatgtgtctgttaacatgactcagatgtgcagtcaatttggggacccactgatagcatcgaccttacagtttatgggatgattctttctgttttgctgatgaaaaaactgaggcacagagagtctgtaactttcccaagttccccttgctgtaagtcctggagccagatatcaggtggagcagcctcttccccatcaccttcccacattttcagctgggtcagttctttccaagtacgtgtttctctcccctatacctcatttctgaaaaaaggaaaacttctagaatgtaacttctttcatctaatacatttcctcaaaacttgctgccagcatcatattctggccacttattattaaagtgagatgccttttttttttttttttttttttttgagacagggtcttgctctgtcgtccaggttggagttggtgattatagatcactgcaacctcgaactcctgggctcaagcgatcctcctgcctcagctttccaagtagttggaactctaggcacacatcaccatttctggctaattttttatttttcatagagacaaggtcttgctatgttgctcaggctggttttgaacttctggcctcaagtgatcctcccacctaggcctccaaaagtgctgggattacaggagtgagtcaccaagcctggcccctgaaatgcttttttttttaatttttttttttaatgaaaatacaggacatggagatgtggaaagacaccttgctttattactgttgttattattattatttctacagtataattcatatatcacaaaattcaccatttttaagcatacatttcagtgtcttttaccatatttcaaagtctcacaaccatcaccactacctaattccagaatattttcataatgccaaaagcatgcctgtatgggcagtcactctccaattccccccttcttgcggtctcagacaaccactaatctactttttcaatatacagatgcacttgttctgggcacttcttctatatggaataacaaagtgtggcattttgcatctggttcttagcatattgttctcaagtttttttagcctgcattagtactttaacttttttatggccaaataatattccactatatggttatacgacattttgtttattcatcaactgatagtgctttaagatgtttccactttttaactcttatgaataatgctgccatcaacacctttgtacatgtttttgagggaacacctgtttttcattttcttggttgtaaacctaggagtgcaattgctacatcatatgtcactttatgtttaacttattttatgtttaactttttgaggaactcacacactgtttaccaacttcagtagctatgccattttacattcccaatagtaacatatgagaattccatattctccataactttccaaacatgtgttttctttatttttttcctaagtcatactagtaggtgtgaagtggtatctcattttggtttaaaattacattttcctaatgaaaaacgttgaacatctttgcacgtgcttcttggccatttgtgtgtttcctttagagaaacctctactcacagcttttttcccattgttaaatttggttgtcatttattgctcagttatatgaatttcttatatactctaggtactagacccgtgttaaatacataatttggaaatagttctcccattctgtggattatcttttcacttccttgacagtgtcctttgaagcatataagatttttattttaatgaagtccattcatctatttttgggttgtttgtgcctacttaaaaaatgtctaatccaaagtcacaaagatttgtacctatgttttcttacaagacatcatttttagaatgagaaatttccttggttttagtggagggcagacattgtttatgcctcctgtccattaccgatgtttctcctgattgttattcatatgctcaccacccctccatggagcatcccacggcctgtaacagagctctggggactgatatccttccactgactttggagctggtgagagccctggtcatgtgattcagcttagccttaacccgacccagttgcacatattcctcagggccttcagagttgaagtcgagaggctctctgagaacgcttgccagcccatgctgttttaaggctggagcaaacttcctccatctattccagacagaggggactgcaggggtaggagtcagtcaagacatctctggtgttagaaagtagagctgtttcagggtttggggaagattgttcaattaaactaagtcctctttgtttttactgtatgtgtgacttctttctacaaacaaaggaagaatatttatgttagaacattttatctattctttatcaattgtttgtctacaattttaacgtggataaaggagagctcagtgtaaatatattcttaaaaactaattatggttcatgtccactaccatgcgatcatatttaaatctatgaactatcctgttacttaggtattatcctgctcctgatgagaaaacaaactcagaaagattgcaaaatttccctaggtcacaaaaccagtgaggagaggaataagaattagaaaccagttccttttggccttcaaagctaaccatataccattagatcaaactgatttacatacttttgctggaattagtctcagagttcatggttctcgcttgattttcccaaggaaactgtgccactttaatatcatttcaaactttgaaatttaaactcttttttattatacttttttgtctttgttctgttccatttcttttgatttcttctcaacgaatccctcttatttatatgctaaatatttgttacctattttctgtcaattttcacatttttgagtgtttgttttctctctgttgtatgctaacagttcttcattgagatacaatttgcatagagaatactgcaaaaaacctaaaggtacagctttataaattttaatataattatacattgtataataacacccagttaaagacagagaacattttcccccatgccacaaggctcttatgtggtccttgccagtcaatactcatcccccaaatgaagaatatattctgaatgttgtcactgccttagtccctttgtgttgctggaaaggaacaccagtggctgggtaatttataaagaaaagaggtacatttttcccatggctctacaggctgcacaagaagcatggaacctgcatctgctcctgatgagggcctgaggctgcttccacttgcagcaggtgaaaaggaaccagtgtgtgcagagatcatatggtgagagaggaagcaaaagaaagtgaataaggtgagaggcactttttaataaccagctcctacaggaactaagagagtgagaattcactcactaccttctcccagggtggggattaatctattcatgagggatccactcccgtgacctaaacacctcccattaacccccacctccaacactggggaccacatttaaacatgtgatttggaagggaccaatatttaaactatagaagccgccagagattaattttgcttattcatgtgcttcatgaaaatgaatcattttggccagtcctggtggttcacgcctgtaatcccaagactgcgaggctgaggcgggcggatcacctgaggtcaggagttcaagaccagcatggccaacatggcaaaaccctgtctctactgaaaatacaaaaattagccaggcgtggtggcaggtatctttaatccctgctacttgggaggctgaggcagggaaagtttgttgaacctgggaggcggagccaagatcgtgacactgcactccagcctgggggacagagtgagactccatctcaaaaaaattaaaaaatggaatcgttgagtatgttctcttgttctgacttctcttactcaggtggttttgtatgccactagtttgtttgattgtgtttttccctcgtttcattttgttttggccaagtaatatcctattgattgtatgattgtcacacaatttgatatccatttttctgatgggagacaggtttacttgttggctgctgtgcataagtaactatgaatattctcatacaattatttctgtgaagatacatacttattttccagggtatctatagctagggatagagttgcttggtgaatgtgtagaaaatgggcacagagttttgcaaagtaattgtattattttacatttctatgaaagatgtaggccatttcccattgctctacattcccacacacttaatattttcagccttttatatatagccattctacaattgtgtagtgatatcctgttttggttttctcaggcctaatgttcatttagatatcttcttatggaaaatatcttctcaaatttttatgttcgttgatatactggggtgtttgtcattttctttgtaatctatagccattctttatatattttgaatgagtccatttatatatacatttttttttttttgctatattacattgcaaataattattcctggtctacagatagcttttaagttgttaatcaacaacataataagtagaaggtttttaaaaatgaagtgcaattcacttgatttcttattgtggtgagtgctacagtatctagtctaagaaatattttcctatgtcaagttcatgaaactatttcctatttttcctttacaggatttctaattttaactttcacatcttaagttaatttcaatgtatgatggagaatggttgttaatattaactttttaaaacaacaaatattatttcactcaaaaccattttacttaaaagtctttcatttccccaatgaaaggcattggtgtctttgtttttaaaacatttagaagtggcagtgcgagcatgttctcactcatgagtgggaattgaacaatgagaacactcggacacagggcggggaacatcacacaccagggcctgtcatgggatgtggggctgggggagggatagcattaggagaaatacttaatgtaaatgatgagttaatgggtgcagcaaactaacatggcaaatgtacacctatgtaacaaacctgcacgttgtgcacatgtaccctagaacttaaagtataataaataaatgaataaatatatatatttttttaaaagagtggcagtgcgagggctgctgcacagctagcagagccgtggtgaggacggcagcgcctgtcccgagctctccgcctcccctgcccgccagcccaggcggccccagcagcagtgaccagaggagcccctgcagcaacgcaatggccaggtggatgcctccatctacagccctgtggcggatgggacctgttaggacatcaccatcatgggcaacaaggacttgaactgggctgccatctcagggaaaaccttcgccaacatcaccccagctgaggttggtgtcctgtttggcaaagacttgtcaagctttttcgtgaatgggctgacacttgggggccagaaatatactgttgtcccggactcactgctgcaggatggggaattgaccgtggatcatcatatgaagagcatcagtggagccccaccttcagtgtcactatcaccatgactgccaagacgccaggcctgctgatgggcaaagaaggagtccacggtagtttcaccatttcataacaaaggaatgttatgaaatggcctcccaccttcagcgttcccaatactgacctcctttgttccttcccctccactgcttcccacagctttgccccactttccttctcatacatacaccattttaatttcagggaccattactccacacaccttattgctgccaaaacaacatgggctgggggccagggatagatggacagacaccttcccctacctatacccctcttgtgtgtggttggaaaacttttttcttttgaggaattttttaggaataaaaaagattctactaaaaaaataaataactatacatatgtttgaatgtatagtttgaatctgtattcttttcctttgatatatttatgaatacttacaacagtactaccatttttaaattactttaaaatcaggtttgaaatctagcagagaaagtgctccaacatattgcttctttaagaccaacttgcctattataggttctttgattttcaaatacattttgaaattagcttttaaatttctctaaaatctcctactagaaatattaatcagaattgtgttgatgtaatatgctaacaaaattgagtcttccaatcaatgaacatgatatccatttctctatttagtcttctttaatttttctaaccaattgcttttaggggccttgtgcctgcttcattgcatgtattcttaagcatggaatgattccggctattaatctctattatgttttattgaatttcattttctagctgctaattgctagtatggagaaattaagatgatgaaatcaactttataaaggtttaatttaggtacaacagactgcaccactttaaaatgcataattcaatgcatgtttacaaacgtatacactaatggaactactgccacaaccaagatagaggaatttatgccccaaagtttcttgtacccctttgcagttcatcagtctttcaaccctcgtgcccaaggaaccgctgtcacttcaggtccgtttccatttttaaccattttctataaatgaaataatacctgcgttcttttgtatctgccttctttcatgcatcaacgtaattttaaaatccatccagatgagtattttcatcaatagttaatgccttgtaattgctgagtagtattccttcatgtggctataccatgtatgtttgtactttcacttgttattggacatttctatcattccatgtttgggctattatgaagaaactatcatgagcatccatacgtggcaggccaggtctcactaacacaggcctccctaacaattatttccgtaccgactgagtggttcagttaaatattaagaggaaggagaaaaaaaaaccagtgcccttatacaaaggctggaatgtaacaaaagcccaccaagagttttgcctaggcttttcctggaccttaaagcatgacaaaataatgagggcattcttaacaggagtcgtttagtatgaaacaagttttattgggggtctgaagaaactccccaggcctccagaaacaagtttattggaggtctgaagaaactccccaaacctctgtgatttagcaggagacaagataagggtccccagcacctagacccatttagattaagtgaatttactgaggctccagaggaaggtcttcaggactcagaccttagttatagattaaaataggttaatcacttatgtatttacaggaatgcacacttccacatgcacatatagcttagaaggtatataagctcaggaaaactttgtaattttgagttggtctggtgataatttccaggccttttccctgtaaccagttgcagaagtaaaaattctcttcctccccagttcatcagcatcttgttactgacacacaagaaatagcagcccgcccctcagtttggtctggaaacagacatacagatcattgtgcagacacagcgtgtaaattcctaggaatggaatgactgtccatctcattggtacatgtttaacctttaagaaactgttagattttcagtcataccatttttcattcttacaagtataaaacttccaagtgctttaatcctcaccaatatgtgctattttcagcatttttaattttagccattctcatggatatgtactggtatctcattgttgtattgattgatctccctgatgactaaacagtagagcatctttttctatgttaattgaccattcatgtatcttcttttctgaagtatctattcaagtcttttgagaaattatttcattgtgctgtttatcttatcagactgcaatatatatagtatatatgtatagcatatatatactatatatatagtgtatatatatagtatatatatagtgtatatatagtatatatatagtgtatatatatagtatatatatagtgtatatatatagtatatatatatagtgtatatatagtatatatatagtgtatatatagtatatatatagtgtatatatatagtatatatatagtgtatatatatagtatatatatagtgtatatatatagtaaatatatgtgtgtgtgtatattatatatatacacttttaaaaaacctttgttggagatatatatatctcctatattgtggcttctttttatgttctcttaatgttccctattaggagaacaatagataatcttcaaaaaggtgaatatatatatatatacacacacatatatgtgtgagtgtgtgtgggtgggtgggtgggtatgtacacatatatatatgtcctaagaatcattaattagacatatatgtgagtatctatttctggattctctcttctcttccactggtatatattgtattttttttttcaacaaaacacatgatcttgattttcatagctgtagagtaattctggaaataggtagtgaattcattcaccattattcttttataatattgctcttttattactcttgatcattgacattaccatataaatgctagaatcagcttgtaaatttctaccaaaatgctgcttggaatttttactagaattgcattggatctggagatcaattcatgaagaactgactttttaaacataacaactcttctgatccatgacaaggcttatctccccactaatttagttctttcataatttctcaaagcaatttttttgtagtttttggtgtactggccttacatagattttgttgactttcttttttcttttttttttttttgagacagaatctcactctgttacccaagctggagtgcagtgatgtgatcttggttcactgtaacctctgtctcccaggttcaagtgatcctcctacctcagcctcccaagtagctgggactacaggcacatgccaccatgcccagctaattttttgtagttttagtagagacagggtttcactgtgttaggcatgatggtctcaatctcctgacctcatgatctgcccacctcggcttcccaaagtgctgagattacaggtgtgagccaccacacccagcctgttgaatttatttataaccacaacatgtatttagatgttactttaaatgaaattgtatttttatttcattttccaaatgctcactgctaatatacagaaatacaaaagactacttatattgagcttatattttgcaacactaccaaactcactaattagttttggtagatttttgtagatttctaggattgttaacacatatagacattatccgtgaataaagacagcttcaattctttattttcaaccttttcaatacttttatttatttttcttactttattgcattgatttagagctctagtataatgctgaattgaaagagtaacaacagatattctacttttttctctgatttaatggaaaagcattcaatcttatgccatttaatataatgttacctgtgggtttttcaaatctgcccttaatggggttggaagtgttgccttccgttcttatcatgctgagagttttctggggtttgtttttataaatcatgaaaaaagttttcaattttgccaaatgcttttactgtgtatgatgaggcaatcatacagtttttctcttttgccctgataatatataaaattatactttttaaatataaaaaagatttcttgaatcaagctaggacagtttttttaattataaacttttaacaaatatattgaaatataacttacatgcaattgagatgcattaaagtgtgtaatcactaaagtgtataattaaagtgtataattttaagagtttgagcacagtatgcatgagccaaagagaaaggacagaaaatactaagtatgtctcagcatatgtggtctatcttggtgaatgttctatgtgagtttgagaagagttatttgttagctgttcttagatgtattttgcttaaatgtcgacttggctaacttgtgtcattgattgtgtgaattaattttgttctagtgggcattaaaattactgtctgatcacattggacttatgtggacttggtttatgttttattacagtggattcatggaaagccaacagcatttcccaagactctctaatttggtaggactcaatcaccaatccacccctttgtggatggtgtcagggtttcgttttagcctttactagggctggtctagaataggccttattgtaaagggtgacacttattcctaaagcacagcctttccagtgtctcaattggatacctggatgctaatgaggtgtgcatgagttcttcccaccctggatggcaggaactccatcatccattccccaaccctcttccaccacaagtacttctggtccaaactcaactttatagcagccactcctatgttaaatctgttagtctttttcttgtgcaggtacagtccattccttgataagtatgcacatggaaccccacatggacttcgagagctgcccctctgaacagctgtctcctattggtgccctgccctgcagattggaatttcttcagtgaccttgaactctgatctctgccttctcagctcagtggggatgccctgctctgagaggactctagcctactgtgcagctgctgagaaattctccccagacaaaaactaggaaatcatggggcttccaccttaagtttcctgttgtactgcctgttgtccactgtctgaaaacaattttatgtttgtttatggaggcagtctgatatgacttattctaacagatagaagtagaaatctgttatagtcttttaattactgtgtctttatagtattatggtagacagaatcctaagatgagctgcagtgatctttgctcttatataatcacttcttcctgagtgtagacaaagccagcgatgagatatcactcctgtgattgtgttacaatttatggcaaaaaagttagcagatgtaatcgagatcccaaatcagtcgaatctaagacagagagattatcttatgagcttgacctaaagaaggtgaattccttggagggactgaggtcttcctggagaaatgtgaagtgcaggagggtttccaggcagggtgattctcctctgctggatggagaaagcatgcagtgggaacgtgggaggcctctaggagcagcaagaggcccctggctgacagccagcaagaaaacagagatctcagtcctgcagtcacaaggaactgaactcagctgacaacctgaggaaacttgagaggaagttcttccccagaccctccagaaagaaacccagcctagtttcagcctgtgaggccctgagaagaagacccagctaatccaggcctgaacttctgatctgtggacactgcaagaaagtaaatcattgttattgtaaccctctaaagcttgcagtaatttagtatgcagcaatagaaaattaataaaagtaaaatggagaagactttggagtggggacaagaatgaaatggtggtagagggatgcctgtatgctgagatggttgatgcctgtatggttgaattgggtctaccattcctcatctaattagctatggtctattaaggtgcatagctatacatgaatattggtactaggtgaatccagaggaataagatattgcattcttgagagtagatgagaacaccctgaattggtggtcaccgtatcatatgtcatatatcaggtccctctgggaaggccagaggaagatttacaggatacactagtgacaacattgaaggcttctttcttccccaaagggaaccaacctcccctcagtcaagacgttccaagtctctgaactggatgccaggttataaattcccactataccgactccatcaagcttctgtcctcagaactagagtttatcagtaaaagatagactcatgggagtctaggcatttattatcttattttatataaatcagctaatgtgcatgaacaaaacagactttgaagaaagaaagtcacagttaccacaggaaaacagcttcgacatcctcatgagtcgtcatgggtgttccattgggaggacttgatatgaggctttcctcctcatgggttagtacagatctgggggaaatgtcatcaagtactcgattcagagtgtagcagctgaggctgttgattcgttaggcctcctgcagctggagatgcaagtagtgcattttcagggccaccacatgtgcccttaggctagcattcttcagagccagaatccaaaaagccacagaagctctgagtatttccctttcctcggtcacccacataaatggcttcaggtccttctggggaaggcctggaggaagatttacagcatacacttgtggcagcattgaaggcttcactctttctcaagggatccaatctcctctctgtcaagaatctccaggtatctgaactggatgccaggtcataaattcctactatggtctctgtcctcagaactagagcttttctaattattacatacattgatttcttagtagatttcccatccattacattcccagacacctcacgatgattagtaatcaccacagatccctgcctctcaaggaaattcctcccaccttgtttctagatggccgcgtaccactgcctgtcctctactcttccagaaccctattgttctccctgacagcagggagggcaaatccatgcagcatctcccgccatgacctccagcctgcagaggagaggtgccacaggacctttacacgcatgccactgttcccctcacctgtgcatttcttaatgccttggcgaggagaatgtccctggatcttcattagtgggagctaaaggaacaaaggtaaataatgctatgggatccactgaaaattggggctgtggaaaagtggccactgaagtaagacagatgaagctattgtcagatactcagtgccagagcagggagggagaggaaagaaatacagacctcacctgcctctcacttccaggctccatcaggtgcccctcattgctaaacctaactagaagtgtgcatgcaggggagccagggatgcattttagaagggtaagccctgagtggcataagacaggatggaaatgagtggagagtggatctgtgggaagaaggaggggatgttattgggaaacaaaaggagaatactagctaataatgctaggtgacactaatattccaaagtctgtgctcatattcagaaaagaaagttcagcagaaagcactaaactaggagtcaagatattatattttcaactgttgttccaacagccatattataaaggaacagtttatttcatgcctttctaatttgacctaaagtgccaggtggcattggggctggcacagccttgctcaattatgtgttgaagagtacacagagactgccaggctgagggaagatgcaaaagaatagaagagacgctctcagggaacaagagaccacacggccccagagtcaggggcagcatcagccactgttggctgctcatttcccagacagagcccacaagcctcagccatgctttgcttctgcaagatgcttcttcaccttttcaataaacctgcctgaatttaagctgataggggtttatttctccttcatcataaatgaaatttttcaccacaacaatctccagtgaattgtgggcacagcaggcaggtgcatccctgcttctgttccactacctcccctgtaggttgaaaaggaggaggtactgaattacctccaaatgttcctctcgctctgatattctgtgattctggtttcttttcagctactttgtttttggaagcatgtatcctaaggcatccagctgaacaacctttgtctactgtgtccaggcattcctggtggtatttcagacaagactctctgggattgctgcactcacaaccactgaaacaattctatgaccatccatttcatggctacatgtttgctcattttgtgtgttcataaagggaggggacagacagcaaacttgcatgttacaaattgtatcatcttaaaaaggaaacaaggcaacactttgcaataaaaccttaagatgcattaaatttaagcctaatgcaataaagaatgcccataaaattcttatctaaagaatgcttagaaaattgttgaacaagggacatcatcatttaaagtgatatgaagaaaccttcttagctaagcatatgggctagattagagagaaaataaaggacccatctcttccctggaaaaactactgatagcatctttcaaaaagctctctgtgattgaggatgcaccttgatccataggctcacatttgattgcaaccggcagctacttcttggcattgacattgcattcccaactagtaaatccttccaagatctgagtttctgcagatatgatattattttttttgaccatccttatcttcaaaggctaccaaaaaggaacaaagattttatttacctccccaagggaaaaggttttaccaatgagacactttcttaccatgaccccagggccccctatgccctgttcacttgagtgccctgtgtggcctgacagaagctcatgctggtcacaggatttgttacataattaacctccttcctgaatcccaacttcatggtggtggtgatgacaggtgtcctgtatcccaggctcatgtccctgaagtcatcagcctgtctccagttagaaaaaattacatgtatatagcgaggtctctttggaagtagcaaaagctttctcaccttcatacattaatggttggaatgtacaatagtataaacactttgggaaaaaatgtctggcatattcttacagaactaaacaactacctattctatgactcagtaattcctaagcatttatccaagagaaattaaaacatatgcccagaaaatgatttatacaagaatgttcatagcagttttattcacaataggaaaaactggaaacattcaagtatctgtcaatacaagaatggatcaataaactttgacacattcattccatggaatggctaaaggaacaaactgttgacacacaaaacaacatggatgaatctcaaaaacattttgagtgcaacaggagccacacacaaaagagtgtgagaaaaaagataaacaataatggtttcaagaaatgcagagcagagagcccagaggcaaagacccacaggatggcaggtcagtcccaggctgtggatcctaattaagaaactcctgctggattttgtccagctccatttccaaactattttaggtcagtgacttctttatcccctccatgttccctcattttgaactagaatcactgtagttgttattctatgtctgtcccatcatttcaaatgaggggcagataagctgtttgttcagtttcacaggtcaaaggaggtaagggaattatgtcaaggatctgtactcagagaaggtaggagcttgagaaggactccatgagttattattggttgatgatggaaaagagaggtaaggaggaaagcaggtggcctctggagtcagagtgtctcccagctgacagtcagcaaagacaaagggccctcagtcccccagaaacaagaataggaaggccttcagtatctgtagtgaacttggaaaaatagcttgagctctagaaaaaaatacagccagcccattcctggattttagcctcacatgactctcatcagagaatccagctgcttcattccagacttctgtggtttcaaaccactggtttgtggtaatgtgataataggcagcaagagaaaactagtacaggtgcctgtctctcctcttgaatttcaattttagatacatggatgctaacccctctaagagaaaaaaattcaatcaataaatcaatcaatgaaagaactaccataaaaatattgccctcacctttatgtggctgttccagagcccttgccacctgaagaagacaatgagggctatttcaggcatgtgaagagtgtggctttactgttatcaatcacatttctgaaagaataaaaatggttcagttcaagccatggctcatgtctgtaatcctagcactttgggaggccaaggcaagtggatcacttgaggtctagagttagagaccaaattggccaattggagaaaccttgtctctacaaaaatacaaaaattaccccggtgtggtggcaggtgcctgtaatcccagctactcaagaggctgaggcaggagaatcacttgaacccaggaggtggaggttgcagtgagctgagatcgcgccattgtattccatcctgaggaacagagcaaaaactccatctcaaaataaataaatgaataaataaaaaataaagatggttcattacttaactccacatattattatatgaaaatgtatcacctcaattttaatagcagattttttaaaattccttttcttgtgctcaccagacaaggtttggtagcaaataccagtcaccagcacagatgaaccaattcaaggagagccataaacaggactaatattatgttcccccaaaaatcatccctagaatgcaatctcttctctacttgtcacaaaacgaacacaatagtccactatataaagtcccaaacacaggaaagtgtaaatataatgaaatctgctttccaaatgtttattctattcagacccagtcatggggaccagggattaggaaatgactacaaacaggttcaagggaatttgggaagtgacaaaatatgctgaagtagaactctgctgatggctgcacaattcgataaatcaacttacatcattgagttgtacattgacaatgggtgacttttataacaagtaattctttaaatgaacttttggatttctattccaacatggaaagagctaggcggtcatgacttgtcctcacagctagaaaaaagctgaaggaactgaaagtcaacccttctagggtagaccagagaattgaggtcacagggaaaactgccatctgaaaaatgagaaacacaggctaacacacaaggagtcacagctcacagggaagagaagctactggggacagcaagtgggaggagcacttaaatggtattgacagattactagaagctcagggtggcctggctagagcactgaaaactccttgaaaaccaactaagggggaatatcacacatttccaagttttactacaatgatctcaactaggttctcatgatgaagttcagaaaaactccctgaagtttggcactaccaacttcagggcttatattaagctacagtagcccaaatagggtgaagttggtgaaaagagaaaacacacacaaatagatccatggaaaagaatacagagcccagaaacagacctacacacagtccactgatcttccatgaaggtttagagacaatttaaaacagcaaagatagcctttccaactagtggtgctagaacagctggacaaccacatgcaaatgtatatagatagatagatccaggtgtgcatgttctaccctttataaaataaatcttacatgtaaatgtaaggtgcaaaaccataagaatcctaggagataacataggagaaaaatctcggggatcttgggttcgatgatggcttcttagatacaaaaccaaaagcacaatctactaatgaaaaaaaattaagttgagcctcattaaaattaaaaacttctgctctgtgaaagacactgttaagagaatggaaaaagcaagtcacagactggcagaaaatatttacaaaataatctgatggaaaaactgctgtccaaaatatatgaagaattctgagaactaaacaacacaaagcaaaaaaaaaaaaaaaaaaaagtaggtgaaagatctgaacacctcattcataagatatacagatggcaaataagcatatgaaaaagatgctcaaaatcatttgtcgtgagggaactgcacattaaaacagcaatgagatatcactgtaaacctattagaatggctaaaatgcaaaaaggtgaacacaccaaatgctgtcaaagatgaggagcaaccagaactctccatagctagtggaaatcaaaagagtacagtcactctggaaaagttaagttctctcaaaatcctgcacataagtacttagagcaattttattcataattgccagaacttggaagtacccaagatgtcttccaccaagtgaattaataaacaaactgtgttgtagccatacaatgaaatctgattcagtgatttttaaaacacaagctatcaagccatgaaaagacatggaggaacttaaagtacataatgctagaaagaagtcagtctggaaacctgcatactctatgattccaactctaggacattcttggaaagtcaaaaagatagaaatagtaaaatgatgagtggttgtcaggggtggaggagaggaggaggcacgaaatggtgaagcacagggaattttcagcagtgaaactattttgcatgatgctgtattggggatttaggacattatgtaattgccaaaacccataatctgtgaaactcaaagaatgaactctaacgtaaactatggactttagttgataatgatgtatcaacagtggttcatcaattgtaacgaatgggctacactaatacaacatactaataggggaaattgtgtgctggaggacaggggagcctaggagaactctctgtactatccactccatctttctgtaaacctagaactgttctaaaaaataatgtctattaatttttttaattaggatgcagcagccccatatcaaggttttggtggcatcctgttattgtgtggttagtacttggcattgaagtgcaccaacctggagtcagagcagttggagatttcaatgcctgtgccatttacctctaaccctggggtgcccccggaatacagctagcagatcagttaggtagaagcagcctcagcaatctagacagtgcaggcttctggtaaggacaggtacaaaccatctgggtgggcagaacttgatgaagactaggaaccactgagactcagcagctgccccagtggcacccacaaatcaaaggagggggctggaaggagctcagggctacacgataagctccctgcctgcaagacagaagcagctccagagattttggtaaataatgtaggtttcagtaccgtgtggtctattcaaaaaagtagaacaaaaaggaaagaaaaagagacagcatgagagagagagaaagaaaaaggaaagaagaaaggaagaaaggaaagaatagagggaggaaggaaaggaagaaggaaggaagggagggagggagggcgggtgggcaggatggagggaaagaataaagagagagagagttggagggaagtagggaaggaaggaaggaaggaaagaaggaaggaaggaaggaaattaacaaatttacatgaagatgagaacatccaggggaacttacaccaccaatattttccattaacaggaacatgctaactagttattagagagagacacactactgtgaaaccatatactgtttccatggggtacaacaccttcctcctcctctgaaacacattctgtctctggcccactgttgccagagacactgagtcttatctttggataagttctggtgcccacaggaatgagatgagatggtggactccagaacatcaggccatgacctttcctgctgctccttgtccactccagaagctatccagctgcaggtgggggcctcagcccctgggtctgacataatccatttgccattctcaatggacttctctccttgcactggttcccactcccccaggacccagtgggtgaccacatgagaaggacacaaacaggccatgtccctttctttctccccctctcaatgcctgcagtggtgggttccattgggtagtgacctgagatttactcattatggggcctctagcccagaccagggcctggtacctaatagtcaccccatgaatgcccagtgaaagaaggtgtccaccacaaggtcctggggaaccaagaattccaccgtggcccataaattctaagtcctacaggattctggaattggagatgggaaaggccttcaaaagtggccactcttttaacctattatactggcaactgagccatgtttccccatcctggacacatctagagggcactgcctaaaaccagacacatctccccacccaggacagagcaggggccttagtctgggggatgcgggtggacagggagggggtgagccacaaaagctgaagaggagaaagcaggtgaaagggtacagcagggtggaaacacagaggaatggaggcagagaatgggggttgagaggggaagagacaggagagggatgcagatctagctactaaggaaaagtcctggagagaacactgtcctctcctgaagtaaaatcactttcacctgaccacagcacttcaggttgagggtggcacaggctgtgaatatttgttcattcatttaacaaatatttatttaatatcagtttcatgccaggcaaggccctgagatgtttagggaccttggcatcttccctttacatctgagtcataatagaaagagggccctctgaccccatcaagctggcaatgcctcaggatttttacctgttggatctagcagctcttcatgtcggcccacaccatgtgaggctgctcttggtgcactgaatggggaagtttctacgtcagtgcctcggagagtccactggaagccctggacagtgggagtcggtggcaccccaagggtggaggccaagagcacacagcactgaagctccagacaccctcaggaggacggtaagggactatcagctggtgagagcctgggtcaccaggaacctttgcctgggtctaaataggatttgccttcagattgcctatgaaataaaagaaagaaatcaaggttaacattgagatttggggcttcagcaacttgaaggatggagctgccatttacagagactgggaagacccagggaggagcaggttgaaaggtggtggggaactagagttggttgggtttctgtcatatgtaatcaacagtcctgaccacctgtaatcctagcactttgggaagccaagacgggtggatcatgaagtcaggagatcgagaccatcctgcctaacacagtgaaaccccgtatctactaaaaatataaaaaattagccgggtgtgttggcaggtgcctgtagtcccacctacttgggaggctgaggcaggagaatggcatgaacccaggaggcggaggttgcagtgagacgagatatcttgttactgcactccaggctgggtgacagagtgagattccatctcaaaaaaaaaaaaaaaaaaaaaaaaaaccagtcctgaccagcctgggcaacatagtaagaccccgtctctgaaaataaaaaatgaaaaattagccgagcatggtggtgcacacttgtagtctcagctactcgggagtctgaggcaggaggatttcttgagccttgagttagaggttactgagctatgatgacaccactgcactccagcctgcggggaaaaaatagagtcctgactaaatacttgagtagccagggaagttttcacaaagtatttgaggcagatcttagtgaacaagaatttgattatttctgttagggaattaagagagtgtgggtgtagttgcttaatgcttattgaactatctttggaatctcatctattggtctatctggtctatctgtacatgtatattctatacactgtctcactgaattttcactaggttatgctacagtaacaaaagccccaaaatcttagcagctacacatacaaaggtttatttttcattgacatatacctttttggcaggttgactatgattctgctctatacaagctattttatttgttagacggttgaaaactgtcatacttggagattgttgaatacggtattagtatgttattcattcattcatttaacagatatttattcgatatctgtttcatgccaggcaaggtcaagtactgagaatacagtggtgaataaaagagacaaaatctctaatttccaggagcttatgttgaaaatgagattgaacacatacaaaataatcataataacaataatgagccctctccctctccctctccctctccctctccttctccctctccctctccctctccctctccctctccctctccctctccctctccctctccctctccacggtctccctctgatgccgagccgaagctggactgtactgctgcgatctcggctcactgcaacctccatgcctgattctcctgcctcagcctgccgagtgcctgcgattgcaggcgcgcgtcgccacgcctgactggttttcgtttttttttggtggagacggggtttcgctgtgttggccgggctggtctccagctcctaaccgcgagtgatccgccagcctcggcctcccgaggtgccgggatggcagacggggtctcgttcactcagtgctcaatggtgccaaggctggagtgcagtggcgtgatctcggctcgctacaaccacctcccagccgcctgccttggcctcccaaagagccgagattgcagcctctgcccggccgccaccccgtctgggaagtggggagcgtctctgcctggccgcccatcgtctgggatatgaggagcccctctgcctggctgcccagtctggaaagtgaggagcgtctctgcccgtccgccatcccatctaggaagcgaggagcgccacttccccgccgccatcccatctaggaagtgaggagcgtctctgcccggccgcccatcgtctgagaggtggggagcacctctgccccgccgccctgtctgggatgtgaggagcgcctctgcccggccgccccgtctgagaagtgaggaaaccctctgcctggcaaccgccccgtctgagaagtgaggagcccctccgtccagcagccaccccgtctgggaagtgaggagcgtctccgcccggcagccaccccgtccgggagggaggtggggggggtcagccccccgcccggccagccgccccgtccgggaggtgaggggctcctctgcccggccgcccctactgggaagtgaggagcccctctgcccggccggtcgccccgtccaggagggaggtgggggggtcagccccccgcccggccagccgcccagtccgggaggggggagggggggtcagccccctgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggtgggggggtcagccccccgcccggccggccgccccgtccgggaggtgaggggcgcctctgcctggccgcccctactgggaagtgaggacccctctgcccggccagccgccccgtccgggagggaggtgggggggtcagccccccgcccggccggccgccccgtccgggaggtgaggggcgcctctgcccggccgcccctactgggaagtgaggagcccctctgcccggccagccgcccagtccgggagggaggtggggggatcagccccccgcccggccagccgcccagtccgggagggaggtggggggtcagcccctcgcccggccagccgccccgtccgggagggaggtgggggggggtcagccccccgcccggccagccgccccgtccgggaggggggagggggagtcagccccctgcccggccagccgccctgtccgggagggaggtgggggggtcagccccccgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggcggcggggggggggtcggccagccgccccgtccgggagggaggtggaggggtcagccccccgcccggccagccgccccgtccgggagggaggtgggggggtcagccccccgcccggccagccgccccatccgggaggtgaggggcgcttctgcccggccgcccctactgggaagtgaggagcccctctgcccggccacgaccccgtctgggaggtgtgcccagcggctcattggggatgggccatgatgacaatggcggttttgtggaatagaaaggcgggaagggtggggaaaaaattgagaaatcggatggttgccgggtctgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctccttaagagtcagcaccactccctaatcttaagtacccagggacacaaacactgcggaaggctgcagggtcctctgcctaggaaaaccagagacctttgttcacttgtttgtctgctgaccttccctccactattgtcctatgaccctgccaaatccccttctgcgagaaacacccaagaatgatcaataaaaaaaaaaaaaaaagatatggaaagattgtaagtaaaaggatttttcttaataaaaaaaaaaaataataatgaatactatatttacaaataatagctgtaagacattttagcacctgttttaaattagaaaaaatatagaaattattaaaactaaaatggccagatgtgatggctcacacctgtaatcccaacactttaggatgccaaggtgggagaatcaactgagcccaggagtttgaatctagtctgggcacgataggaagaccacgtctacaaaaaataaaaaattagctgggcacggttgtgtatgcctataatcccagcactctgggaggctgaagcaagcagactacttgagcccaagagttcaagaccaacctgggaaacatgttgaatccccatcgctacaaaaaatacaaaaattagccaggcatgacagcacatgcctatagtcacagctactcaggaggctgaggtgggaggattgcttaagccaggaggtggaggttgcagtgagctgagattatgccaccacattccagcctgggcaatagagtgagaccctgtctcaaaaaaaaaatgcaaaaactaaaataaaattgctacaagattaatatataaaaatgagttcatattcttaggctaggcattgatttcttttttctttctttttctttctttctttctttctgtctgtctgtctcttttttgtacaagacagagtcttgctctgtcaaccaggccggagtgcagtagcacaatcttggctcactgcaaactccgcttcccgggttcaagcaattctcctgcctcagcctcctgagtagctgggattacaggtgcccatcaccacacctggctaattattgtatttttagtagagacggggtttcaccatgttggccaggctggtttcatactcctgacctcgtgatccacctgcctaggcctcccaaagtgctgggattacaggtgtgagccaccgcgcctggccgggcattgatttcttaaacaggacacaataagcagtaaccataaaggaaaagattaataagagtatatttcattaaggctaacagaaaaatgtgttcatactcttagactaggcactgatttcttaaacaggacacaaaaagcagtaaccgtaaaggaaaatattgataaagcataatttcattaaaattaagaaactccgccaggtgcagtggctcatgcctgtaatctcaacactttgggaggccgagccaggtgtatcacttgagcccaggaattccagaccagcctatgcaacatggcaaaaccccatgtctactaaaaatacaaaaaacagctaagcatggtggtggtctcctgtaggtcccagctacttagggcctgaggcaggaggatcacctgagccttgggaggtcgaggttgcactgagctgtgattgtaccactgcactccagcctgggcaatagagtgagatcttgtctcaaaaagaaaaacaatttagagaatctccattcatgagaaaacaccattaaaagagtgaaaacacaagctgcaatttgaaaaaagagaaatgcaattcatatatatcctagaaaggaggcatatccagaataaagtattacaaatcaacagaaaatcatatcaatgaaaactggataaaaagattaaacagtcacttcataaaagaggacacataaatggcaataaaagatactcaatctcaataccaggaaaatggaagttgaacccacattgatatattactgtacctctactagaataacaaaataatttttaactgacaagcatcagcaaggatgtggggtaactggaatattccctgctaattggtaaaactactttgggaaaatgttcggcaatacgtaatactaaagttttatcattcatatagctctaaaaccaacaatgccactcctacatatacaccccaatacagtaatgttctatttcttaatctgtggtggttcatttagtaaaaactcatgacctgtacttttttttttttttttttttgagacagggtcgcactctgccatccaggccagagtgcactgacgtgatcaccgctcactgcaatatcaacctcccgggctcttttgaccacgcagttaatttttgtatatttagtagagatggcattttacccaggctggtctggaactcctgggctcaagtcatccgcccaccttggcctcccgaaatgctggaattacaggtgtgatctaccacacccagaccacctgcacatttaaaattgtgaacttcctctgtattcttcagtaacttttcgaagatttctttgacacgaagttctcagaaatcttaaagctaggattttagaatagaaaaaaaaagcttttggttcactggtgaaattttactaattaaatttaaaaacaaaaagaaagttattaatgcatatcacctcagaacaaagattaaaaactacgagcacatcagttttctttaacttcgtgaagcactgggattcattctttcggcaaagaaaggatgaacaacactgtaactcaaagaaaagataccactgcaagaaaaggccttttttttttttcttttttctttttttttttttttttagagggagtctcgctctgtcgcccaggctggagtgcagtgacaagatacctcggctcactgcaacctccgcctcccgggttcaagcgattcttgtgcttcagcctcccgagtagctcggactacacgcgcccgccaccacgccttgctaatttttcgtatttttagtagagacgggttttcactgtgttagccaggatggtctcaatttcctgacctcatgatccgccacgtcagcctcttaaagtgcttcttttcgaaagcagctccaccagcaaaaggtaggaggaaagcgaggaaaccattccaaaagtcttggttaactcttgggtgaaaggacgccaaatgagatgatctaagaagcctcaaggaaagaaagacagacagacaggcacaggaaaatcacagcaactctttggactgcaaacaccaacaccacagtccaacctaccagaaatcctgctgtgaatttgaggcttgtcccgctagtcatgaggtgattcagtgatggctacaaacgctccttacgtgcatcctggacctggtacacctggcttgcccatcaccagcctggagacaccgccaggagcacaatccctgaggccaataaagaccccagctttgcaagtcaggggcgcgagcactcttgcccctcaggttcccagaagaaaccgccacgagggtggggtgcggggtcagtgtgctccacaggacttccgaggacgtgccccccaagctgctccgttcctccaccccctgggatgccacagaacacccgccagcgagtttcttccccagcgcccatgagaggaggctgcgggcggcagccgcaagcgaggaatccagcgcagggaaagtagccccagtggggcccggcgcgtcagccccactcgcgtggcaaaacttgcgggggcccccgcgtgccgcgcctcagcccagctgtgcgcccgcaggtcccagactcgccgcccgcctgacctggcgcggcgccctcacctcggaacgctgggtggacttcgcagtaaaccttaacttcccatccaggcggcagcggcgcggtgcctcggcttcgctcctggcaccgcaggtcgcccgttccgcgttcccaaaagcatcaggctcacttagaagctcaggcagcctcgcgaccctcacctacccctcccagcaccgccgctgtctctaccgccgcccagcgcaggcgtagcagagacttaaaaggacacggccgcctctaccgcacaacgggttggagcaggttaggggccgcaggggctgagaaaacgagtaacggaggacagagtgcagtggggacggggaaatccctctcctccccctctttttcaaagcaccagcccttgaccctgcaattcgctgatttccccggccactggaagcgcccctgccaggttaaagaggcgggagacacaccccctctggagccgggagctaccgggcgtttaggactccaggcctcgcccttccgcaccgccccaaagtctgacttgcaggctcgggccgcagacccgcaggcttcagaaggcagccccagctcccccgagaggtggccttaggtcactcgcaaaaacagtaaccaacgtgtcgatggcacttgtattttctaatttaaatttataacacatttcgcagatgggcttccactgaaataagcctttgagaaaaagaaaaacttttttttttcaacaagattaggaaataccaagacatacgaagtaaagccatgccgtccacccagctaaaaactttgaaaacttgaaattttatctaaggcaaatgtttgcataactttaggtcgtgccattatttaaagtaaatttcaattaacaatatcttttgcaattgaatccatcttctataagaaaactaagatacatccctgataatctacctctcccctcctgtattccatccatcagcaaatcctactggtttttaccttccaaattttccttgaatctgtcctcttctgtctcctccatcaccaccctagtctaggctaccttcacctggggagtgggggtggagggactactgacctagtctccctgtggtttacccatatcccctttatcgcctctctaatcttaacacaacaggcagagtggctttttcaaaatataatgtgaaccctgtcacttcccagcccaaaccacttaagcaccttcccattctcttagacaaaacctcctaactaaccaagccctgaatggccaggcaccttgcccacctctccacctcttctcacaggtcagaccaattccattcttttctctctgctccagccaaactggcctcttttattgcctatttacccagcttcctggactccacagagcttttgctcatgctttgctctgtgcctgaagattcttccaaccctcatcattctgacaacagctgtagtctccacctctgagaggcaacttctgacctccctacagtggtcccttactcttatcacattgcataaaactgtaatcgagtggttatgttggggaattttttaccatcagctccataagtccaggatttggttttgtttggctcatgcttgtatttccacatttgtgaaatacatatttgttcataaatgagaacgatcgatgttagaagttgaagtaaatttggcataaagtcagagaaaggtaaaatgtcacaatctaatatttagagtcagaatctaaaaacttcagttatattaaaactgattttgtatcattttaggctgggttgtcgcagggattctttgggtaatctttaaaactgagttctcagagagcattgtataaacacctgaattaataatgatagccatgggatggtccacataaaactaataatattggttgcttcaagggaggaagaccaagccaggaacagtggctcatgcctgtaatccaagcactttgggaggccaaggccgacagatcatttgagctcaggagtttgacattagcctgggcaacttcgtgagtccctgtctctacacaaaatataagcaaaattagctgggcttggtggacacctgtagtcccagctatttgggaggttgaggtgggaggattgcttgagcccagaaggttgagaggctgcagtgagccatgatcatgccactgcactccagcctggatgacagagcaagatcctgtcaaaaaaaaaaagagagagagggaaagaatcttgactggtggctactggtgggaaggaggtttttactacatccccaattggacctttttattttaaagtatctgaagataaataaatgacacaaaagagtgcataccatcccatttatttgaaattccagaaaaggcaaaattaatctgtggtgagaaaatcataacagcagttccttctagcaggggattcactgggaaggtacacaagagaaatttctgggtgctaaaaatggtctgtcttgataggggtatgaattacttaagtgtattctttcatcaaaaacattcagttaacattcaatgaatgtaaatgttaccttaaaaactataaacataattaaaaatttaaaatctggtcgctaacacctggttgagcgctcagtgtatatggggattggccaaagctataaatacacaattttgtttagtcctcatactgtcctctcaaggtaagtattattatcataatccccttgcatatgaagaagcccaaatttagtaaatactaaataacttgccttactttatgccacctggaaaatggggaaagagctttgaaaaccatcagtcaaatgccagaagttattaaacattagaccctataacacttctctgaaattgtaatatttttggcatatatatatatatatatatatatatatataactcatctactagatcaagagcttcagaatgattgaaatcatagtttgtgttttgtttgtttgaggtttatgtgtttattttatgtcattattttaaagactgggtcttggctgggcatggtggctcatgcctgtgatcccggcactttgggaggccaaggtgggtggatcacttgaggtcaggaattcgagaccagcctggccaacatggtgaaaccccatctctactaaaaatatgaaatcagctgagtgtggtggtgcatgcctgtaatcctagttactcaggaggatgaggcaggagaatcatttgaacccaggaggtggaggttgcagtgaggcaagattgtgccactgccctccagcctgggccacagagtgagactccatttcagaaaaaaaaaaaaaaaaagactgaatctcactatgttgcccaggctgcacttggactcttgaattcaagctatcctcttgcctaggcgtcttgagtagctgggactacaggcacacactatcacgcccagtattttgtcttaagtttctaagcagtcccaacactgcacagtagctgttcaatgtattttgagtgaatgtttaaaaacaagcttggtgttgattttattgctacaatttatatttacatatgtaatatttatattatatgctttctatatatttatatgtgtgtatgtatataattggcaccaacttagcattgctgtgcttaagtgcctgagatgtatctcaaatgaataggcctgaggagagaagcttgtgtcattagctctgaccctgcagcactaatccttatttacccctttctttcactcaccctgagcacataaatatttatttggtgaaagagcttacactttaacatcgcactgaaatagctcattccaaagaaagagctaattctaacctctcacaagtgcttgagcatttgcataagtgaaatttcactgtgtgagtttcacccaacaccacctctgctccagctcctgctactctactgctcataccatggaactccacaggtggagtagaagatggaggatgcacgatgcagtacacagcagcatcctcctcagagagagttttatttgcagtaaattcagtgtgcaataggcaaagcaacgaagagtcaaggtgaggcaggagagcagcagagggaagtggaagttggataaagagtgaactgagtaggagcagaagcaggttaaaaaggtgggtgagcctagaagaaaacctaggcaataccattcaggacataggcatgggcaaggacttcatgtctaaaacaccaaaagcaatggcaacaaaagccaaaatagacaactgagatctaattaaaacaaagactttctgcacagcaaaaaaaaaaaatatatatatatatatcatcagagtgaacagacaacctacagaatgggagaaaacttttgcaatctactcatctgacaaagggctaatatccagaatctagaaagaactcaacaaacttacaagaaaaaaacaaacaaccccatcaaaaactgggcaaaggatatgaacagacacttctcaaaagaagacatttatgcagccaacagacacatgaaaaaatgctcatcatcacttgtcatcagagaaacacaaatcaaaaccacaatgagataccatctcacaccagttagaatggcaatcattaaaaagtcaggaaacaacaggtgccggagaggatgtggagaaataggaatacttttgcactgttggtgggactgtaaactagttcaaccattgtgaaagacagtgtggcaattcctcaaggatctagaactagaaatactatttgacccagccaacccattactgggtatatacccaaaggattataaatcatcctgctataaagacacatgcacacgtatgtttattgtggtactattcacaatagcaaagacttggaaccaacctaaatgtccatcagtgatagactggattaagaaaatgtggcacatatacaccatggaatactatgcagccataaaaaaggatgatttcatgtccttcgtagggacatggatgaagctggaaaccatcattctcacaaaaaaccaaacaccgcatgttctcactcacaggtgggaattgagcactaagaacccttggacacaggaaggggaacatcacacgccggggcctgtcatgaggtggggggaggggggagggatagcattaggagatatacctaagtaaatgacgagttaatgggtgcagcacacgaacatggcacatgtatacatatgtgacaaacctgtacattgtgaacatgtaccctagaacttcattaaaaaaaaaaaggtgggtgagcaagaagcaagataagcagaagttgagcagcgaaaacaaaagtgagatggagtagtgagtaaaagcttatggctggcaggatccagagcaaaccagtaagaggcagctcctcagagataggcatgggtatgggagagaaaaagtaggcttaaaatgaccccgtatgataatcagctcattaaagctaatgcatatggactgcatatcatgggtgtacttaaaattatgggatggaggtgaccgggaagcacactggggccaaataactaagcaacccacctatcaatcagaaggcacatgctgggtagagattaggcagccccaggaaaaggagaaaaaatatatatataaaaagacccaaagcccaaagttcaccaaactgatgctgatctcattttgcagaagttagcctgttctcccctctctgagagtgttactgtgcttaataagtcttttgctgctttgctacatgtgtgtgtgtgtgtcacagccaattctttgtttgagacaccaagaacctgggacttcacaacaccagccagtaacaaagatatgtaagcttgggagggaggaaagaaagaagggagcaagaggagattcagacatgagatgcattcaccctatgagttgaaccccagtctccagcgtgggagttggcaattctattactgaaccatcaatgctccatgtggtataacctctcatgatttttgtttgtttgttttgttttgttttgctttgttttttcaaaaagagaatctctggtggtataggcaggcatgaggggtcagggaggatggaggtgggaaagttctataataggctgacacagatatttttggaaaacagagctaacaaagcaacaggcacttgaagcaaaggcttgccctaaaccttccactgtttgccaagggaagaaattttggagtcaaattttcactttctctcttgtgtagatctctgtaagacataaaagtttggatgacagtcattttgattcttggactttactagagactccaaagacgcatctgaggagaaaagctctgggtccctgggatgactgtgccactcgacatagcctcctggagtggccaaagagagtgtggttgaaaaaagaaatattggagtgaactttcactcactcccacttttgtaggtttcttaaaaacatgagtttagaaacaagatactgggctttttcaaatgactcaaaagaggtgtagatgaagagaagctcgatcatcccacagatcttttggagtaacctggacacatccctaaatctccagctcctgggtctttgaaagccagtttgtctcagggttgggaggcaagtgtttggaaagcaccaaggcaggagttggcaaaaaggttacctcatcagtgaagaaatgaaatttccagaagttttcaccagatctgggaccagagacaaaggcctggatgaatttcctatgcaaaccttttttagaacctctgtttcagagttcttccagagactcttcaaaattagatctggtgaaaccgctgctggtggtggattggtagttcagcagcagaatttttttctcccacgcgggagactcggtccgactcgcggccatgcaggccttcttacccttcaggcaggaagggctactacctttctacccaacaaagttattatattacccaggctgtactgcatttatggaccttggtcgtggcagctacaagttaacctgaggggcgtgccacctctggagcattctctgtgctcgaactaatcccgggatttacagttcctgtgctcgaagcctgtccttgaaagtgaggagtgtttccagtaggttgctgtagttttgaatactgggaattaaaacctttgctactttcatctagtctccggggcaaacccctgggtaacccaaaggccatcagacggattcgcgtgctgggctttccactaccttaggccacgtgtcactatggagcgaagatcaagaaggtcccggaaggagagaagctgcggggtccagggagactttttggtggttggtcggagaggcttcagctgcccaaggaaaagggaagcgtgtggggaggtatccgcatagagatgagggcctcggcggagacagtctcacgcagaggtatgccaccttggcatctgcgccttccgtgggccagtgggtcttccgggagggattctgtgtccctggtattgtgtgtcaacaggtgttagcctgatagttatatttttaatgagagaaaacgaactacagaatttgcgagttttgttttttttctggttttgctttatacctcttggattctccttccaaaggattccgatctgaggggcattggggtgtgactatggtagacaaggagtggtgaattttcatccaaaaatctttggcggattcccttgctctcccgctccccagtctaacagtagtttaaaacagaagatcagcaacatttggagagttttttttttctctgcattctgatgataaacttgatttattcaattccaaaaatttctttattctgaggttgtctttctatattttgagtataaaaccatggccatacaatgttggacccaccaaggttcttctcttcacttgtttatttgtacagtctctttgtaatctcagaatttcttgagtaaactgggaactgttatacataattctgtgtttttgagcattctttgtaaacaggaatcaggattgggggtggggaaggagggaggagtgggagtgctgatttgtgtaacggaaaaatcatagattacttatgtgatggggcaaaggttttaaaaactcttagtgtcctcagatttccccttatactatttgctgaagaaaatcatgtccttgactcccttccttaccctctcctggcaagggaaggggtcccctcctgcctcagggtctctgtcctcctggggttaggagaagcgcatccaactccctctccaagtgctggagaggaggctaagtctttcccatgggctgggggctttgctgtcccaaggacggctggggaggaagaggaggcagaggcggaagaggaggcagaggcggaagaggaagccggctgagatttgtgaagcagctcttgctaccgcgggtaggagagggcgcgcgggacccaagagcctccgtgcggagccaggcctcaggagcagccgccttggtcctggaagggatgcctccctccatcctgtctccaaagaatgtagggagaccttctcacccggtgggaaagcgacgtctcccatgctttcccaccacggacgccttatgtcccttttcctgctagtgtctgaccgccagcctgcgggggctgcggctgcaacggttccaagctgggtggaggctgcctgcccgcgagccaagagccacgctaggaggcaggagtcgggaagtcgtgtgcaggcccggaggagactcaagctacgggtcaggcttttttgccaattgccaaattcagcgtgtaaaacagagagctcacatctgtctgtttgtaagcttcggtgagaacaacaaggaaggccctcaagatccctaggagggcggcgaagggtctctggcgaagggtcaccgcgtcggcggtgagccaaggtatgtcaggagagagtgcgaacccagcccccgggtagcacgaacaccaccgcagacaagggccccgcttgtggggaaatcgcagggccagtgcagccgcagtgcggtggactagcctcatccagggagaacccccttcctgaccacggtctgtcccccgccaggtaagaggagaggagggacagtacagcctcctgtcccgtagccgcaggctcagggtcaccaccttcccctctgcttggccggcgccattcttccaaaccactctccgccaaagattccacggacagtcacctacaagacaacccagccgtcctttcagcagcggatcccgccccgcagccaccgcgccctctcaccccagcgcttctacccaccgcctctgcccagtctgtgcacttcacctccctcgccccggctcccctctgagcttacagtggacagggggttcgtccccaacccttcttgggaatactgaatagaaaagggaggagcgtgcgcaattccttggtagtgtgtagacggacattgtgggatttgactgtggtaccatcgctttgacgtcctagtgatttttacacctgccttctgcttagaacaccggccacagttttccatttgtgtctactccacctgctgtctttgttggataagtgaacatcgtccccctctaccactcaatcaacaaaagggcggtcctggaggacctcacccgccgctcacctgctgctcacccccctcccaaccttgcggacatcgcctccggtcgcctcttcgtaaggcctaagaagcacgttagctgcgaacggaggtgaggaggctcagctgaccgcctgtgtcagctgacaacgtgtgacacgcacaaacgccaggacttggcttggcctctctcttagttatttgcagctctgcccaatcggcgcctccgggacggcggagacggtgggcttcttgggtgcagctccacgaaggctggcatccctgcacagcggtgaacacctgagggagacgctcagtctctctctaaagccacttctgcggatgacacggagataaataagagcagtgtgtcatgagaggccgtccaccaggacttgccctcctttgccagggtttgcacctagcagagagactgttctgcctctggcccttggagcaggctggctgacagcggagtaaagaaaaattactgcgggtgtgcagtcagtgcaaaacaattctctgaccgataattgaacccgggatgcggtggtgaaagagctgaatcatagccactagaccagcacgggggcacgggagggtctttctcaaccttcttgccatataagtgactgtttccctgtgcgctgggaggacttgggccttgtgggggtcgttggtcgctcctggagtcgtctcacaaggcctttccctccctcctttctccaaaagaggagcccggaggcgacgcacccagtactctgcgaggcccaccaaggccacgagtcccgagtcctggagcgagttgcagcgtccaggctgcacctgaccactgacctagaaatgtgcctttgcgaagcggcagcgcatggagaaacagtcgctggtggccagggccagagtcgcgcaccgggtagccagaacaggcaggagcgaggaggctcccggggtgagaacggggcaccccgcacatcataaaggactcagaccttggcaaccccgacatcataaaggactcacacggatgtggaaaccgagacgagctggatggaaaactttccaggggggctccggggccctcaactgctctctgaccttcccctgcaacctgcgacacctgccattttcccatcttaggcgacggcaacgctacccttccttatgctccaggcaaaactcctagagttccctctgacgctggagttttttcctcaaatccaaaatccaattggtcaccaattcgtgatttcccgtcggccaagtgcgtgggcattgatctacacgcgaatttctccacctcggcggaatggccacttaggggtgggggaggggccctccggtggattgtaaggtgtttagcagcatccctcgcctccgctgactagatagatgccaggggttaacattctccctccgggcttcccctagtctggcctagtgtcccagcggggatgggggagtagtctgagggtgaagttgccgcctattgagaaccactggtgctcatagtcctgccctctgagcttgtgcagaggactctccagatgaaggctcaggggtcgatccagctcgagaccccctcgctccccccgcacagtcggaccttaaaattggagggttttaacatctcgacatcatgagattctacctttaggtcttttcttccgttctgtccgccaaatcggcctcttccgagtttgttgaccagggccagccaggcagaaggctggtttcgctcaaagaggatcccctcgccctcctggagcttcaggcctgtttccgttgggtctgcagagaagccttaggggccacttccttcggcatggggagggggaacaggtgctcgctgcgcggggaagaagagggtttgactgctgttctcgacccccagcgccaaacctccaccccggtgcgcgcccctccaggctcctgctggtcccactcgccggtaattaggtctccggtcagcctcagctcccgagacacccaggcccagaaggacacgtaagggaaagcagctattcacttcggtcctgtccgcaagggatccctttctgacgggaaagaaaggtggcgagtcccgttctgttgagtaagcggaagagagatcaaagggaagagaagaaaaatcctgtgaggtttcaggatctaaagttaccatgaagtcgacctaacctcgtctggaggtcctcccgtggctggcgaaggtgagtcgagtctccgtcttcagtttgtcaaagtggacaaagcctacgacaactgccagtaccagctactaggcatccgcagtctttccagttggtggtactggaggtccctacccaggatttccgtggattccaagggtacaactaaacagcttttgttgttccaactgctcttatttgaagaaagggccgatctgttgagaatcacataggaaaaccacttccataagagtgtagctactgttgttgagactgtcacattctccctcctcctccttcctcttcctagaaatgtgcaatgaaaattaatccccacgatcggcctgttgtactttcaatgtacagttggcagaacctaaggtaactctaggaggttccgggatgaatatttgaagtatgacacagtcatttttatttgcacgtgcattccaaaaacacattggacaaacacatccagttcacctgtgccacacttacaaagacgcgaaaagaggggctacatacaaacaagtgaaagatgtaatcaaacggcttttaaatgtctgctgtttccactgaaggtcttcttctctggatacacctaccagtgtcttctctttctccaaaaccagacattcaagtgccagaccctgaaatcagttttctggttccaacttgttcttccccattctgtatctctgcccctccactctcttctttcatatgcaggaaagttcagctctccctcagtttccaatttgcaacatcccattcgaagaatgcaatgaccagcatcaaaaattagacaccttccatgggactccgtctctctcttagttggagcttctataacaatgtaccataaattgggtgactcatcctaaacagacatttctcacagttctggagttttcaagtctaagatcaaggtgccagcatggtagggttatggtgaggaacctcttcctggtcgtagactgccgtcttcccactgtgtcttcaggtggctgaaagagggggaaagagctctctagtgtcccttttatgggggcactaatcccactcaggaggactccactctctggatctaattacctcccaaaggcccctcctaataattttaacacatttcctggggtgggcaggggaaggttagggttccaatcaaggtattttggggggacacaaacattaggtctcccgtgatctttctagaagaagaaattatacatgacccaaagttttgtacatttcacagttagaaataaagaaaactttttctaagattttgaaaggcctgaaacgtgaggccaaccaaccccatcactaaaatctggactctgtgctgattgttgtggactttttgcgtgttcatcctccctgcagacaactgaagattcattctctccagagggtagaagagaagatgtattgggagaacccacccccaatatttcaaagtaggttctttctattttccgtaagtgtcagctggctgaaaaataaagagacagtacaaagagaggaattttgcagctgggccaccaggggtggcatcacatatcagtaggaccatgatgcctgcctgagtctcagaccaccaagttttcattaagggtttcaaaaggggagggtgtgtaagaacagagagtaggtacaaagatcacatgcttcaaagagcaaaaagcagaaccactgataagggtctaacaaagatcacatgcttctgagggaacagggcaaagggcaaaagcagaaccactgataagggtccaacaaagatcacggggcaaagggcaaaagcagaaccactgataagggtctgtgttcagtggtgcacatattgtcttgataaacatcttaaacaacagaaaaaagggttccagagcagagaaccggtctgaccacaaatttaccagagctgagttttcctaaccctagtaagcctgagggttctgcaggagaccagggcttatctcagtccttatctcactgcacaagacagacattcccagagtggctgttcatagacctccccccagggatgcattcttttcccagggtattaatattaatattccttgctagggaaagaatttagcaataagtttcctacttgcacgtccaagtaggccccctgcaagaagaaaattatggctctttttgcccgaccccacaggcagtcagaccttctggttgtcttcccttgttccataaaaattgttattattctgttctttttcaaggtgcactgatttcatattgttcaaacacacatgttttacaatcaatttgtacaattaacacaattatcacagtggtcctgatgtgacgtacatcctcagcttatgaagataacaggattaagagattaaagacaggcataagaaattataaaagtattatttgagaactgataaatgtgtatattaagatgaaatcttcacaatgtatgttcctctgctgcagctgcagcttgtccctctgtttgggttcccttacttcctgtaacaaggatccttggccccaagggggcaatcagcatagatgagcaaagacttgtgtcccacactgaaatgagagggatgaagtgacagcatatcttgatctatgtgatggttacataagttatgacctatttcaaagcttattatgctgtgtgaaaaagaacaaaaccagaggacttgcacaacctgacattcagactcactctaagctgttataaacaaggcagtatgcaagcggcattggaagacacaaatacatcaacagactgacttgggagatctgaaactgaccacagctgtaaggtccataggttttttgtttgtttgttaatttctttttgttttctgagacagggtctcactctgtcacccaggctggagtgcagtggcctgatctcagctcactgcaaactctgcttcccatgctaatgcaatcctcctgcctcagcctcccaggtagttcatactacatgtgcattttagtagacatgaggttttgccatgttgtccagactggtctccaactcctgggctcaagtgatccaccagcctctgtctctcacagtgctgggattacaggcatgaaccaccatgaccagtcacaggttttcaataaaagcagttcaatggggcaaaggaaatagtttcaattaattgactttcacaaagaagaaaggggagatgaacaaggttatttctccctcacactacacttgaaagtaacttgaggcacattatagaccaaaacttaaaagctaaagatataaagcatttcaaggatactttgtgacttgttggtagacagagatttattaaacagggcacagaaaaaaaatgtataaaggaaagacttgataaattagacttcatcaatattagccatatcttctcatcaaaagatgccacaaagaacttgaaaaaatgaatcagcctcagggagaaaatagtcacaaaacctatctgacccccaaaccctgtaactataatgtatggtgagatcttcttacctggtaacgaaaacaacaacaacaaaacaaaaacaaaaaataatcaacccaagtatgctagaagggtaaaagacttgaacagatacataagaataaaaggtacacacatggtcaataaagcacatacaatatgtttagttatcaggaaaatggaaattaagaccacactgagacaccactataactcccagtagcatggctaaatttatagggagaggaaacacccaatcttggagaagatgaagaacaaccacaactctcacacgtcattggtggaaatgtaaaatgacacaactactttgggacgttttgtcattttttatgaacttgcccatatcccactctttggtaccagcaattcggcacccaggttttcccaagagacacgaaaacagatgccctcaaaatctcttgtgagaagaaagttcaaagcaggcttattcagaatagccaataccagtttattcagaatagccaatatccagactctcattatgagggtgggggtggggcgggaatggcaaacaaactgtgctgtttctttgcaatggaatactactcagcaatgaaagaggaatgaacttctgctacactcagcaatggatagagccagagacattatgcagagagaaagaagcatgtagaacagagtagatgcaccgtgattccatctgcgtgaagttctagaagcaaaggtaaagtgaaaacaatctggagagtgattgttcacaaataaggcagaggacaacgacaatgatttttataattctagtgattacgttgttgattgagtagtcactaaatccaggcacatctgacaacaacggtgtaaggcagagtttgcgaagtggcacaaccttccatagaaaaaatgttgaggcacataaaatgtaagatacttaaccaaggtcaggcaaggactgacacagatttccaacacagaacctgggttcttggacatagattagactggacctgtccacttctctgtttcaggtgtctctgggattctcagctgcaccagaggagagagagaaggacagagaaggagacagagggagagaggagtagggaagaaatggagggaggcacagggcctgtagctgttgaagagcagagaagtaactcttgccagtgtatttacagtatagaaaagttttctggcgatcaggacattagcagatgctaagcttgctgtggtcaggagatgaatttgatatgccatagatttagaaattaaaacgaaaccctaaagttattggaagagaatgtagcagaatacatttctgccttaagagataacaggaaaaaataaagcaaagtagaatttaaccaaagttatcaacttctgctcatcaagaatcaccatgaaaagggagaaggtgagccacagactgggagaagataattgccccgtgtttacctgaaaaaaaaaataactcaaatcttgaatatagagagtactttttacaaatcagtaataaaaggcaaagccaattgaattagggaaaatgcttcaatagcctctcttctcaaaggattgctaaatggtgaaaacgcattagtaaatatgctcaacagcattactcattaaaggaaacacaaattgaagccatgatgtggtaccgttttacatccaccagaatgggtgtatttaaaagacagtaaacaccacgtgctgtcaaggatgttcagccagtggaactctccttgctggtgagaaagcattctggaagaaaccatttggccgtttctaataaagttaacattacacctaccatatgattgaacaattccagtacttggtattcctcaaaggaaatgaatgcacgtgtccacaaaaagaccccacacaagaagaatcttcattcgccttgtccagctagtggaatctgtttcttaccagcaggagtagaagtctgaacatttctcttggtatcatttctcttggcctcttggtatcagagtcgccaaggaaaatacaacgcagtcaagcactggacggaaaaacaacacattattcacacagagaggagacacagccgggtgtgggctccgcttcagtagtgggcgttggtcccccatggccatctggtccctccatttggcctgcacacacagcctcttgagaagcagaagaaagggcccctccccctcccctcagcggggagcagatacagcagctggccaggtgccagttgatgcacatgtttaagtggaacaaaggggtacacagtctgatcgggggaaagatactcccacacaaggaggtgagtccagcacaggctgtgaggactccttatctcttgggaaggaagtgctccaggcccaaggcccattcctacccggcagagtggaggtggaaagacccctggcacgagattgcctttccccacactttcctgttggcatacaaacttggcgacgagctgggagacaagccattgtaggccacaacaaagagtttgaagtttaaagtcattaaataacagccccagtgactggaaaacaggttctgagggcaccattgccttcgtgtaagccaccaacagggctgactgggttatttgctgtgtgaggctcggaaatggacggagcacgtccagcgcttcccttggattcctcgccaggttagtgggctgtgaggtctcttttcctttccctgaggcgcctggttgcagggagcgaaagtggatagctgacggcctggaagaacgacattgccgtgactcggattcgaaccgaggttgctgcggccacagcgcagagtactaaccactatacgatcatggcgagccacaggccaagcgatgatagctgagcttgctctactaattttgacatcaatagatttcgattattaggcggctttgttcccagacagctacagggggatcgcgctattctttcatacccgctctgcttttccctcccttcctcccaatcctcatatgtgatgagaaaaattcttatctcctccactccagcctgggcctctctcgcgaagtctctctgtcctcattcgcacctcctctacttctctccggcctctccgtatttctgcttttcacccttcctctctcccgccggaccgaccgaagcagaggtgagcgagggtagcgcaagcagcgtagcgagtcaggtgaaggcggagccaagaactgcgagagctgtcactagagcccaccgggcgttctgcttgcttcccttcggacccacgcgattcaggctcagggagtcgcggacccgggcgtttccaggatgctgggtctgatgcctgcgaggggcaggacgaggcgaaggccattccgctgcccttccagcttcagaatcacccaatgcacgggtttcaaccgtagccggcaagctgcccctctccggttttccgaggctttggagcctgcacaattgttctacaaaaggcggtggctccgcctaacgttagatggacgcttgctctgcgtggtgataccagagcgagagtcgactgttcctgtgtcgcagtcgggtggtgtgcttgcttccaagtctggaggcgggtggttcgagctcgttctatggaacgtttcctgcattttaaaaatgcttaaaccgctggcaactttcttctatccagcacatgcactcatggaaaggcagagcgagaccaactttaccctcctctcatccctctccctctccctccccctctgcccctccccctccccctccccctccccctccctctccctctccagacggagtctcgctctgttgccaggatggagtgcagtggcgcgatctcggctcactgcaacctccgactctctggttcaagcaattctccttcctcagcctccagagtagctaggcttataggcacaagctaccacgcccagctaatttttgtattttttagtagagacggggtttcaccatgttggccagggtggtgtggatctcctgacctgatgatccgcccgcttagcctccccagagtgctgggattacaggcgtgaaccaccgcgcctgacactctctgtcattcatttagccctttccatacgcttttgaggttaaattggttctgtgattttactattacatataatgctctagtcattcttgtatgggcactttcagccactggtgtaagtatttctatagggtagaggtgcaattactatgtggaaagcaattactctatcatagtgttcacacggtttttatatcattccattctctctcctctgtttgcttattagatataactctttcttttgttattttagtaattgccttagggcttatagcaaaccattttaacttatcacagtcaaccttcaagtgatattatacctcgccttctggccttgatgctgatgctgtagctgacatgcactttgcttttacgcatgttacaaaccccacaacacattgttattgcttttgtttaaatggtcaaatttttacaaaagaaatttacagaataaaaaaaaaactagtatagttacccatttctggtgttcatttcctcgtgtagatctggattttcatctggtattggattccttctgcctggaagactcctttgacgtttcttgtagtgtgggttggctggtagtgaattctttcagcttttgtacatctctaaatgtccttattttacttccagttttgataatttattttttgtggcatagtattctaggttaacttcccctgccctcagtaccttaaagatgttgcttctatgtctgctcatgtgcattgctgctcctggtagaggccggcaagagcagaaaggaagctgatgcaatcctcatctttgttcctgtgtatgtacaatgtatttttcttctggccggatttgagcaatattattatgaggtatctaggagtggttttcttcatgtttcttgtgctttggtttcctcagctccttgggtcactggatttataatttttgttatgattggggacttttcagctattgtttcttcaaaaattggccggacacagtggttcacaacttcaggaggccaagtcgggaggtgttgagtgaggcctgaaatttaagaccagcctgggcaatgtactgagaccccattcctaataaaagtaacaaagaaagaaataaatgtttcctttcccccctgctccttctcagggacttccattactcataatttaaacctcttaagtctgccctacagttcactgataatcttttattttaaaaaaatctcttttgtctgtgagtttcattttgcatattttcaattattcatggttccatgttccctgatcatttcttctgcaacgtctaatctgctgttgatcccatccagtgaatttatcatctctgatattgtggttttggcgtgatatcggctcactgcaacctcctcctcccaggttcaagtgatcctccggcttcagcctcccaagtagctgggactacaggcatgtaccacgataccaggctaactttttgtattttgagtagagatggaggtttcaccgtgttagccaggatcgtcttcatctcctgactttgtgatccacctgactcagactcccaaagtgctgggattacagtcgtaagccaccgcacccagccccctcccttccttccttccttccctccttccttccttccttgagacagggtctcaccctgtagcccaagctggacttcagtggtgtaatcttggctcacgcaacttctgcctcccaggctcaaacaatcctcccactgcaacctcctgagtagccgggactacaggcacacaccaccatgcctggctaattatttgaatttttttggtagagatgaggtttccttatgttgcccagtctggtctgaaactcctgagctcaagggatcagcccacctcagcctcccaaactgctgggattacaggtgcctgtttgtttgcagagaggagcagtgagcagatttcaggcaggagagttaatcgggcatccgttactcaaactttgccgggagcctaaggcatctctttacatgttcttagtttgacttcaacaggaggtgtgtcagtttatcttccaacatatttttccaactcaatgagagagccttttccttcgtgctcttgccagcacagcagtttccatatatcagtctgatgtaccagtgagggggtggtgccctgcctgatttacctaagcaggaggtgcagcagaaagacatggtggacagttcccagagatactctctggcacgtgttccacagctaaacctccaagatgtttagaaagtcttccagtaattgtaattgttttctctggtgatctacctaagcccagagaaaactggctggagagaccctgaactgcttcctgtcaagaggcttatcaaataggaggggaaagaatggctccttctagaaatttgttccttttctcttttctttatgaattgcattctgcttttgttgaatgcaaacgatctacagactgttctccctcctagacaagggtgaattggcatgctaataactacctctgtgttattccttccttgatggtgtttgttttgttttgtttttctgtaaaactcatctcactggagacaaatctctggatcctgcacctcaccatgcttcttatgcagacctggatccttggagttattggctccctttgccttgtttattttgttgactctcttcagcaaaactgaactccaacttttacaccctaaatctggctcttggacatataggtccttttgctttctgactcctcctcaacccagccctgcctttccaacctctccatctgtatctgtgtgcctgtgtctgtctgtctgtctctcataccccaggctgcccccagtattacccactttcttctccccctcttcagtgttcagggtacaccttcttctctgcctacagagtcccacaggctgagggtgcgtccccttacagagaggggagctcattccagaaggtgccctctagacttggaattaaccctacaaacaacacccaggtttgaaaagctttttctgtcttcccattacctgcattattcaaaggactaaaagtggggagtccagtagaattcttgatgtctctcagaagcctgcattggaatgccttcattcaccgagcatatgttgggtgctcacaaggtgtgaagccttgctctaggtgagtagctgcatggtgagcaagtcctgccccaccgagcccacatctggaggaatcaaaagggaccgggcagtgggaacacaaccagctcgtgtcctccccacaagtgtttccccattcgggcacagggaacacaagcggtaagcatgacagataaagcatagcgaaggatggggaagtgggtgacttcagaccaagaggctactgtggtcatgtgcagtggggccacttccgacaggggaagtgcagggggacagtgtgggccagggagaatgtcgtggatctggcattcctgcatcttgccctcactcacatggcctggtgtcaactcagaaatgtgcccaaccacacaacttctggcctccgtgtcacctagaagacatctagaacccatgcaatagcacaaagaagtgaggatgtgcagcctggggatgggggcatttaataatagacaggtgtctgaggcagatgtcctcagatttccaggcaccacttgcctctttgtggagcaatcagggcaatcatcggcaaaaaactaaagactactcgtcctgttccatgcagaggcgtagttaaccttgtaactattcttttctgaccttcattcttccacgtccagatatatgggggtctttgttgcccatctgcttcaagttagatgaagaaaatcctgcctgaaggcttaagggtttgttagaaaaataaatgctgttcagaaaaggtgcattttaggcaaaagctcagttctggagctccagaacctacctatcccaagcccaatacacacctcctttctctccctccctgctcatcgcacctgccttcgctgattcttcaggctgcacatctctgagaagatgacaatccctagcagaagaacaagagaaccttggacacttctgtccatgaagccatagacgcgagcagatagcctcattccatggcggtgtgactctgaagtcactcaggttttctgtgcctccatttccacattgtaaaatgggcccaataggaatgagtttctgaatgggttgttccaagtttaaataagacacggcagtaaaacattgaacacacaccctgatgcatagtaaacgctccaagagcagtagccattattactatcattatcatcggtggcttcatgacggctattatcgttatctacatccatctttgaaataattgcatatccttttagggtatggagggattgcaacatataacaaatcctaactgatgaacatttcttattacaaatattgctgctgggaacatatttctgtattttaatcatcacctgtgtgtttctctatcaaatcttctcacacaatttggggatgttgcaaaagtcattccctgaccgggaatcgaacgcgggccgcggcagtgaaagcgccaaatcctagccacttgaccaccagacacagaaatctccttgtcagaggaaacaagagaaggtaaagattaactttctaagaggaggagagccccactgaaaatggctctctgtgacccaagcgggctgcaggactgcagggctccaagcagtcactgcccagctgctcaacacctctcacctctgctagcctggccactgctttgggctgtattgaggacaggccacaaggaaactgagcggtgttccattctagccttgctgtagcatggtgtgaggcagagccaggcacttgctctctttccgagcctcagtttccttgccaccaaagtgcggacgtggctctcagagggtgatgagccgagtccttctagttcccgatctctgaactggctcaaggggctctaccgataaagacatgtgtaggggtcccctttcgcccccaactagctcaattagtagagcatgaaactctgaatggatgggtctttggctcgagctccaggtgcagatttaggttcattttcttttgttccgccacacaattcgaccggttccgcaactgagctcgggtcgcgaggaagccaagtgggcttcacaggaaagacctccttggtttcagagacattgtagctgtcagcttgaaatcttcagaaagaagatttcggcgatagatgagaagactggaaatttctggatctaaagctaacatgaagtccgcctcatccggcgccctcgtctcccgatccaattcacggcgggcaaaccaggcctggttcctaatgctcagcgaagggtttcaggtagtaatggaactcctcccgtgcttccagaagctgctgcagccggcggggtttgagcgccggagttccgggcggcagtagtgtggaccccgcccctccaggtctatgggccccgcctcgggaccttatccctggcgtccggccttcagggctcttggctttgacagggtaccgactttcgtggtccttccaggagctgcaggaccctgcctgcccgcccttcactcaagtcaaggggcctcatccctgtgctctttcctcgctttgggctctccactcagggtgtcaacagaggtaggtcaggtgagaaacctggatttccacacacacctggctacaaggagatggcaccactccccttctcctgcagaagcagactcagaaaaaaggtaattaaaacagaaggtttcaataaaatcgagagtctgataacataatacccaaaagtccaagtttctattgaaaatcattcattacactaagaaccagaaaatcttattctgaatgaaaatagacagcaaatacacaccggcaataagatgagagaggggtcgggattgtctgacaaagattttaaagcaagcaagcctgatgaaaatgatgcagtaattatgagcacattcgaaacaaatggacaaatagaaagccttagcaaataaatacaagacttacaggagaaacaaatggaagtattagaagtggaaaatacaacaaccaaagtaaaaagtccggcacataggctcaacagcagaatggatggtgcagagcaaagaaatccatccactgcagatgaaaaaatagaaattacacaatcttaacaagcaaaaaatagactgggtgagaaagtgaatagaacctcagggacttgtggaactgcctcacaaggtctcactttcatgttgttatctatgtctggaaggggaagaagaagaggaagaggctgaaaacataaagaagtcaatggctaaaagcttgccagagttggcaagagacagaaacctacaggttcaagaagctgtgaagaccccaaataggagaaaacccaaagacgtctatggcaagatacatgaaaaaataaaatgtaggaaatgaaagacaaagaaaatatcttgaaagcaacagagaaaggtgacactttacctagaaaggaaaaacaattctggtgatgatggatttctcatcagaaaccaaggaggcagaaagaagttgtgcagtgcttttcaagccatgaaagaaaacaattgtcagcccagactcctctgtccagcagaaacatctttcagggattaagaggaagatcaaaactgtttcagattaagaagagctaagggaatctctgaccaccagttctaccttaaaacaaaaggctaaagggagttctctagacagaaaggaagtgattaaagaaggaaccttgggacatcaggaagaaaatttaaaaaaaaaaaaaaaaagtaagcaaaataggccttccttcttctcttgagttttctaaactatgattgacggcttcagaaaaaaatcatagcatcattcaaagtggttctaactctccaaaaagaaaatgtttgaaacaattataaactgggagggtgaagagaccggtaaggaaggtaactcatctatcattcactcatactggtacaacaatgacaccagtatactgtgtggtaagacatagatgcacagacatatgaatatcagggaaaaccaagagggctatccaaacagatatatgcaaaaacactatggataaggcaaaacaccattctcaaagacgttcaagtcaccacaggaaggtaagaaaaagaaagcatatccagaaaacgacaccagagagaacaaacacaaaaagaaaaatataatggcagacttaagccctaccatatcaatcatcatattaaatataaatggcctaagtacaccaattacaagacagagattggcagagtaggttaatggacatgacccaactacatcctggctgcaaagagactaccttcaaatatgatgatacaggaaagttgaaatcaaaaggatggaaaaagatacatcatgcaaaccttagacaaaggaaagcaagactggctatattaatgccagatatagtatatttcagaacaaagaaactaatcagagacagagagggacattatataatgaggaaacaaccaatccacgaactcctctcctgacaaaagtcataaatgtctatgcaacaacaactgaaagtactgaacagagaactaggcaaatccacaaatatagctatatgcttcgaagttcccctttcttaacaatttatacaaaaaccagacagaaaatcaacaagaatatagaagaacccaacagcatgatcaaccagcggggcttaaattgacaattttagaacacccaaccacgtcagaatacacattgttaagggatgcattgtgcccggcccccccagattcatatgttgaaatcagaacattagtggcaactagtaatatactagttaaaatcacaatgagaaattgctaacatacctatcagaatggccaaaagaaaagcatgaccacatcaagtgctgtcaaggattcagagaaagctggatcactcatacattgctggtggaaatgtaaaaagtgacagcccactctggagaatatctgtatagtttttactttttaaactatatgtgcaactaccataccacctaggaattgcattctctgcatttatcacagagaaatagaatcttatgttcacacaaaatccatgtacttaaagtttatagcagccttgtttttaatagccaaaactgggggaaaaatgtatagacgactttcatgaggtgaatggttaaacaaactgtgatatatatccatagcactgaagagtcctcaataattttttaaaaaacaacaaactattgatacccacaataacctggatgaatctccacagaattatgctgagtggacaaagggtaatcccaaaggtgacatgtaggagtccatttatgcaaattattcttgaaataaataaattataaaaatagggaatagattagtagttgccaggggttaaggagggaaggaggagcagcactgaagagacagggtcatggctataaaaaggcaacatgatgaatcctagtattgatggaaatgttctgtaccttgcttgtatcaatgtcaatctcctggtacagtggcatttgcaatacatttgcaatatttgcaaatattactaagatgttaccattggaggaaactgagtaaaggatacaagggacctctctttttctctctgagttcctaagattgtatgtgaattattaaaatgtaaaaattaacttaagaaaacctaagtatatttctcctttactgatcatgcctttgcttaaaaacattaaggcaacaatatttttcccaacaccctttattttcttgaagacagttttaacaaaagctgttcttagggcttttcctaaaagtttaaaacttccagtaatccttactgttcttctttgagaaccctccagggttttgttttccaaaagaataaagacaaaaactggcaactggcatataatactatattagtcttagttctccagagaaagaaaatgagcaggatacacacacatacacacacagaagcagagaagcccaagttctactctgagtaagctctagacctaggagagtcaaatatagttcaagacaaagtccaaggcttaaggcagaagactgatgtcccagctcaaagacagtgcagcagaaaaacttctttcttaacccttcatcctagtcaagccgtccatgggttggatgaggcccactcacactcaggagggaaatctgcttcaatcagtttactgattcaaatgtcaatctcttccagaaacaccctcagagacacagtgagaaatcatgtctaaccaaacatctgggcactccctggcccagtcaaattgacacaaaaattaaccttcacaaatgctctcaatagaagtgattaataaatgtagcatcatgtactgcctgtttatcccgtgacaattaatatattccagcataacattggcttctgttcccttactgtaggaacacataggagtttcatttaaagtgaggataacttttaccttatggagtctctccctacccgtacctaccattgccacttgtggattgtcattttgccatggctttcttattcataatatcaataagctgtatactttgctaatgtaagtttgaatttcatcctggctgcataagtcactttccattttgacaaagcctagaaatatttttgtttatctcctgtatattggtaacacatacctattgtggggcccactctcaatctcatggttttctttattttcattcagctctcaatagatatgcctaggctgcttgaacatcactgaaaatggcctgtggccttgtccatctatcagagtccagtaaaatcctggccatggaatggggggatggaaagtgagaaccaccaaactcagcacacaaagactcagtttaaacctctgcgctaagagatgaccagactctatcatggctcctaatagcataagaccatgtcccatggatgaccctaggctcccatgacaatgcctacctaagaaagctcaaggctaccaggggaacttactttagttctagccaatacctgctgatgatggtaggttctttcttatagcatttactaagaagggaatccctcctccatccctttgagatatgtatgtatctcctagggactccagtgtgtctttccacaggatttgaaagccattccttttaggtgtagtcctcaggaaggacagaatctctgtcttccggtctctgtgggaggttaggatcctaacatctaatattgccagctggcagaaacagctgtcctgatgaggcagaagcttacaatgatcaatctttcataatgtttcacttgtgccctgaccctgccctctcccctgcctcactctctcattagaatgccatcacctctgcacaaacgggatggaattcagccccctctgctttggtcagtagttactgaataaaatctgttttcacagctttgactaatgtctgactttatctttgacaaaataagtgcaagcaattgttttgagcaacacagcagccacaaagagaggcacagacatgtcgggagagggaggaatcatctgacccttctcatttcacaggcatctattcctgcctggtgtttatgagcctgagacttggctgggctgccctggtgtatcactccatggctctggggcaagacttgagtaggctggtggtggcacttggtgtgaccacagccaccttcaaagatgccattaagggttcacaagaaaatgaaaggaaacatagagaaactgattttgaaagttgttgcctctcctgcttcctcattcagagtgtgtatgatattgctgtgtgatgttagttggactgcaatttagcacaacagctgttctaataattggcagtttctcatcgagttaagcctacctgaaagggaagcacacttacctttattgatcacccccgttaaatgaacaatacatccaacaaggcttctaccaaaaatgttcttattaacctcatttgtatactaaggaaaaactgggaacaacacaaaccttcatcaacagaagaatttaatacggactgttatatagtcataaaacgatcccagaagttcgctgcataacatcaaacccaggaacccacactgatgccactgatggcagaaaatcttgatacaaaaataagagagacgagagacagaaaatgtgctataaccatagtagtgggtaaaagccaaagagctcagtttctattcatgatattcgatagaagaacagaaggaacatgagccaatagctctaagggtccaggtctgcacaaggtgcctgttgggtgcagggttctgttggctccagtgttgtatctcaaatgggctaatttttatggacatagccactgcagaaatctatcaaagaataataaagggatagctatttgcatgttaatttaccattgtataggagggagaacgggccttagattggtttggtcaaataaaagcaaaaccgagatttatgaagaaaagaggaaaggggagaggaaaaaagtcatctgggaactttgtgattttgctccccttggataagcgacttgacagaaagctgtcaaagaggtcattgtgacccatcttctccatacccacatgacttggtcaccacagaaaacaattacagatgttggaggactttaaaacatcctagaagtttaacagctcatcctatgccacagaatatctgtgagtaatgtccaccatgtccttcggttgtacaccccctcagttaagccaggaggacgcctcttccctcagtggaatatcatacgtcgatgtgtagaaagttggttgtgccagcaagtaaatgacaaaagggacattgatagaattgggaaacacattggagtatgatttgctactgctcccacggaagataaatttgcagaatgtactcaaattagaagcattatataaatgctgtaatgtaaaaatggcacatcctgttctctacactatagaaatatctgcatgagtgaccaaagatatgtgtacaagaatggtggagattgcagcatcatttgtaatcctaaagtcatgaaacccacctcatttcaaaaacatcttgaaaagggttaaatcatgcacaaacagaggaagaaatgctgttttcacaaacaatggcgaggatcaccatgaggatgagtgattccactggtcacattattgatagagcaatcagtaaacccaggcacatcctgagaataggatactactgtaatagctctcctattactaaacatgaaaaactcgaggcactttactcccacaagccttccatgggagcaaagaacatttttatcacactagaagtgagttcctctctaaggtctctgggattcctgagtttgacagatacaaggcaccatgggccttgccaagcctcagccctagaagatggggaggaggacatgtgtgtctcctgattaggctggagttgattgtatatcaacagaaacaacaaaaatcaaatcatgaactatttttctatggggaagttttgttttgttttgttttgcgacagggtctcacttggtcgcccaggctggagtgtactggtgcaaacaaggctcactgcagcctcgacctcctggggccaagtgatattcttgcctcagcccccaagtagctgagacgacaggctaatttttgtattttttgtagagacaagatttcgacatgttgctgaggctcgtcgcgaaggggaagtaagttctttttaaaaagcatttattccgattgatttctccgcatcctgtggggcgcgcaaggggcaaggcctcccgtggcctctcttgccactctgaaccagggagctgtgggggctcagctgcgttgtttttgggtgcgtgtctggggcaggaggccggggccgggcaaggggtgaatccaacagggaactgcgaggaggagggcaaggaagtcggtagaggcatgcaccagggaaacttcccagtagctttgtgcagcgataaggactgcacaagggagagatgagaagtgttttcttattgtatcagaatggggaagaaaggggggaaaaacggagagacaccaagaaagaacgaaatctacgcggacccttgggtctccaaaagggaagcagtcctgcattaagtttaaagaaggagcgcggcgcgcttcagctcctgtggcttgccgtgatcttattgtggttagtactttacgcggtggccgcagcagcctgggctcgaatcccagtcgtggcaacgtccattctagggtgtagcgctcttctttccctttagcctctaacctcagcctaggctgcgctgttgacctgcggctagagaggtcacaactttcctgtgacttcggaactctctgtggtgtcgagaatagaaggaaaccctaccctgaatgcctaggggtccggttatcttgaaagacttttcctcctctctgagcaagtacaacacccaaaagatgaggtgccccctctcagtcagccttattggaatctttaatgttaacatgatgtggccgtacccgtttttctggctcagatatttcaaaaatccgtggggcctttttcaggccaaatcagaaatgaacaagagaagatgagagttcgcactccaactgggtattttaagcaaaacctaaagaatacaataaaatctaaagtttgtgactttctccaaccccaatttttaattttgtttttatttatttatttatttattttgctatcagtaaatgattgaagtataatccacagagaccaaagtgcaccaatcttaagtgtgtgagccagtgcattttgacaaaagaaaccatcacctatgtcaagttatggtacattttcaacagaccaagaagtcattagagcccctttccagtcaatcctcaccccatccccatttaggcaatcaccattctgacttctatctccgtgatttactcttgcttcttgtagaaatcacgtaaaggactacattgattttacctgttttcttttaatgcaacaatgatatgtgatgcttccattttatgacatgtatctcagctctttggtgttattgatgagtgttattccaacatgtgaatatactacagttgatggacaattgggctatttctagttttggctattgtgaataaggtgtttacaaatattctactatgggtctttttatggacctgtgccttcatttctattgagtataaatctagtaatggaatggctgggtcataaataggtgtatttttaactgtattagaaactatcagacagtattttagaatggtggcactattgtattttctctctctctctttttttttttttttttttttttgagacagagtctcgctttgtcacccaggttggagtgcaattgcaggatctccactcactacaacctccacctcacgggttcaagcaattctcctgcctcagcctcctcctgagtacttgggattacaggagtgcaccaccatgcctggctaatttttgtatttttagtagagacagggtttcaccatgttggccaggctggtctcgaaatcctgacctcatgatctgcccacctcagcctaccaaagtgctgggattacaggcgtgagccatcacacctggcctatatgcaaacttctgtatcagaatagaaaagttgagaagatagtacacagaatggagtaaagaggatggaatgggtttttggaaaccaattcacaatttaaagttgttttaacacccctaatccccaaagaaaaatgtatattctccaaagacatccctttcttaaaatatgcagagaaagtgtgggataaaagagcatgtagtaaacttctcagaacgtgtgtctggaagtggacaggggaatgggagtgggatgaacagagaaaagaaggaaagacagtaagggccttgctgagagcagccaccataatgtgccctgagctaaggtacatgattaccttcttcctgtgcacctgagatctaacagaatgtattgacttatcagggatatggaatttcaaaaacactacaggaaatcaaaaaatttaccaaaacagaacagtctagttaagaaaggcaggaagagattttataaacaaagcaaaaacacagaaatcatacagtgaggtggtgggaatgagactatgcgcatcgtctccaatataacactaattactgctaattataatggatttaagtatctcatattggatagaaaaggaaatgccagctctaatgctttaatggtggaaaagggttaaatattcaaagcagtgcacattattattgttagtagtagtagtagtattttgagatagagtctcactcttgccagactggagtgcagtggctcgatctcggctcactgcaacctctacctcctgtgttcaagcgattcttctgcctcaggctcctgagtagctgggactataggtcgcgcgccaccatgcccagctaatttttgtatttttagtagagattttagtagagatttcatatcggccaggctggtctcaaactcctgacctggtgacccacccgcctcgacctcccaaagtgctgagattacagatgtgaaccaccgcaccaggtcaaaagcagtgcacattatcattagcaagctagcccagaaagagaaaaccaaacaccgtgtgttctgacttataagttggagccgaatatgagaatgcttggatacataggtttcgggggtgaggacaacacacactggagcctgttggaaggtgggggttgggaggagggagagcatcaggaagagtagctaatggatgctgggcttagtacctgggtgatgggaaggtcagtgcagcaaaccaccatggcacacatttacctatgagacaaacctgcacatactgcacatgtacccctgaacttaaagtaaaagttggaaataaaaaattttttaaagtcaagaaaacaaacaacaaaaagagtagtgcaaatctgtaccatgctcatttgtaccactcttttgtttgtaccaccaaacaaaagaatgagagtgaaaacatgaatatctgacaaaagtaaacagcaaaagaacactttatgttaggagtaataccctagcatctacctagaatgaaatgaaactgtttttccctgaactggcctcccaagctgaactcttgggactgtgcctgggatgctccaggagaccagggtgataattgaacttccctcctcctacacctctatcgagttcctggaaaacgccagcgatcagatcttgcttttaacttcttatactttacagagacctaaacaagagggaagaaatggacatttcatgccaagatttcttcccttcacctcacactcgagttcctgggttctgacggccttttttgaggaaagtgctgatgtttgcgtcaaggttgggaggaaagggtttgggaggtaccaggcaatggggaggcaaagagaagacatcaacaagcgaggcaagaactttccacaggctgacactggatacaagaccagagacaaaaagctgggtgaatttctgatgttttcctacagaggttttttatccagttgcacacagcctactcagaataaggctttttcaagtcaacccttttaatgtgaagccataattttgtggtgttgcctgatgcaaatctccactgtgagcctttgctctgggtgtcttttttgttagtcacatcttccaaagagaacatggtgaaaatcttgactcctttccccaagtctgtgtcttaactgtttccaaggctgcagagctcgggggtcaggaggcattggcggtacagtggcagaattctcgcctcccacacgggagacctggattccatttccggcaaatgcagcgtcctgtctttgtgccctgtggttttcacatttacttactgtgccacgctaatgaagaaaaaaaaaggagcggggggtcgggggaaccactgtgtactcctcaggttctttccgtagcggaatttatttttcttttatttatttatttttgtttgtttgtttgtttgagacagagtctcggtctgtggcccagattggagtgcacttgcactatcctggctcactgcaacctccaccttccgggctcaagtgattctcatgcctcagcctcccaagtagctgggattacaggcacatgccaccatttcctgctaatttttgtatttttagtagagacggggtttcaccatgttggctaggctgatcttgaactactgacctcacatgatccatcagcctcggcctcccaaagtgctgggattacaggtgtgaactccgccccggagcggaatttacctaagcagagactctctttgaagcagcctgtgggtctggttggtctccgcgtttctacatatttggccctaaaaccggcacgacttttatcgtctctgttgttggatctctgcagtacaaagagtcacctggtcactgattctctgcctggaccttggatagaccattgggacacatcttgcgatggagtgcgactcaagcaatgacattcctgaaaggagagaagctgtggggttgggcggacacacgcaatgttggggaactgggacccagggagaggggagacgtgtgagaaggaacccacgtgcagatgaggggagctgcagagaggggcctcggaccttcctgttgaggaaagcccagtctttagtggtctcggcaaattaaaggattggccccgagtggagagcagcatatccccaaaactcatttctatcagccctgtttgttttacactgcaccaggcaaatcttctgtccacgggattctttttaatgcttctctttaagcagcgtggtggggaggccatggcgatcattagctctggaggcctggggaggacactctgaagaagaaagccctgcgattatccggtttcaccctgttttcatctactctttgcctcagcgaagtttatattgggtcctctatgttacatcacagctgctgcactggcggattaagagccgctgacaagtctctttcgggaaggggtaagaagcgcagctggcccagagccatggagagagacgcaagagcagaaccgaaaatactttcctccttcttgttctctctctgctattggtgaacatcaaccttccacacaaaccggttcaatactgccttggtctctacaggaggtttaccaatttttacagttcccgtaagccatgttttcttctcgtttctacagttcttccagggttgagtttcaggagctggtcagcagtccagactagttcaacatcctggttcaaaaccatttgtctcgtttcgctactagggtaaagcttgcctcctagaccagagttaagacgtgttccctcggcttctgttttctagagagaattggcatagtttcttccttaaatgtttggtagtgaaaccatctagacctggtgctttgttctggaaggttgttaattgttgcttcaattgcattaatagatagagacctatctaggttgtctatttctccttgtatgagttttggtcaactttatctttcaaggacttggtccaattcattgaagttatcaaatttgtgagcagagaattgtgcataatagtcctctactatccttttaatgtccacgagatctgtagtgagggtcattgttttctttttcatattagtaatttgtaccttttctcattgtttcttggctcaccagctaaaggtttatcaattttattggtcctttcaaagaacactctttaggttttgttgacatttttctaatgatttctggttttcaatttccttgatttctgctttagtgtttattgtttcttgtcttctactcactttggacttgatttgctcttgttttctttgagtttcctaaagtgcaagtttggattattgattttagatttttatttgtaatatttaatcttttaaaatccattattattttactttttgtacagtaattcttttagtgtaatataattttgttctggtaaaaatttcagttttattttatgtaccaagtgtacatgtataggattgttacatggatatattggacccaggtagttcacatagtacccaatagctagtttttcaacccactctccctccctccctccctacctcatggtagtccacagtgtctacggttcccaggtttatgtctgtgtgaactcaatatttaggttccgctcctaagtgagaacattcggtatttcattttctgattctgcattagtttcctccagagtatggcctcctcctctctccatgttattgcaaaagacatgatttcattctgttttatgggtgtatagtattccatgttgtatatataccacattttctttatttaatccaccactgatgggcatctagcttgattccatgtcttcgctattgtgaatagcctggtgataatcataggagtgcatgtgtctttttcttttaatgatttacatttctttgagtatatacccagtaacgagattactggttgaataacagctctgttgtaggttctttgagaaatctccaaactgctttccacagtgactgaactaatttacattcactccaagcatttataaactttctctccagagccttattagcatctgttggtttttgactttttaataatggccattctgagtgatgtgagatggtatctcattgtagctttgatttgcatttctctgattattagtgatgatgagcatttattcctgtgtttgctggctgcttggatgtcttcttttatgaagtgtctgttcatgtctctttgcccactttttaatgggattttttttcttgttgatttttttaaagttccttatagattttggacattagacctttgtcagattcacagtttgtgaatattttctcccattctgtcggtggtctgttgactctgttgatggtttcttttgctgtgcagaagctctttcattgaattaggtcttacttgtgaatttttgtctttgctacaattgcttttgtggacttggccgtaaattctttgccacggctgatgttgagaatgatatttcctaggttttcttctacggtttttctgctttgaggtcccagtatatattgtgtcattgcaaatgacaaccaaccagaaactaatcattacaagccaagaaagggaacttattggtgaccaggaaaaatgtccaacaaatgaaaattagtaaaagagattcctgggtgtctttttctgtaaagcctggggcattgttgtctgcagagttcacattttctgtaaagggccagggagataggaagtattgtaggcttctgagccaagaggcaaaattaaggatattatgtaggtgcacatataaccaggaagaaaacaaatttctaagccatttttattgatgagattctaaactaacaatagcaactgagtagaacttctcaggtggtaaatgttcgctgcattgagagcctaggctcagctttcctagaatccctggtacagccctccctttccaccccttaggctgtttcctccctgttttcctcagaagagttccatacaaaagacctactactctgagaaacagtgaagtactcctggggcccaccaaagcacacgagtcaagaagtggatggccttgtcccagctatggctcagatcacctttgcaggatgacatcttgttgggagattgtcatcagagccagggacatggaagatgctgtcagaaggatgaaaggactggtgcccagggggagaagtggccaagcaactctgcattcagcctcacaaaaatctcaaggggatgtagaaatgggaacagggcgaatggaaaactctttcaagcagggttttggggtcctgagctgatctctatttttcctcctacaacctgccgcacaggctattttctcacctctgtggatggaaactgcatccttccatatgctcagtccaaaaatctttgagttttctttgactgctgatctttccttcacaccctatagctgtttagtcaagaattcacattatgctgagcatcaggtgtgctccttaatccacaccatccttttcccccagtttataaaacttgtaaagtcattctcctgataaagacaataggatttccatgaaattgcacaatttttatccttcctggatacatgactcatgtaagagctctgctattgtttgctaccatttccccctatttttatttcatacctgtttgacctgcattctttcccataagccaggcacttcagctcaggtgtgctttcctaatcatagaattagcaatagcagccttgctaacaacttcttcctggccccaccaccaggcaaatgtcacaggatttaataggtaaagaatcgtaggatcgctgagcatggtggctcatgcctgtaatccaggtctttgggaggctgaggtgggtggatcacttgaggtcagagtttgagaccagcctgaccaacatggagaaaccccgtctctactaaaaatacaaaattagccaggcatggtgacgcatgcctgtaatcccagctacttgagaggctgaggcaggaatattgcttgaatctgcgaggcggaggttgcagtgagcctagattgcgccactgcactccagcctgggcaacaagaactaaactccatttcaaaaaaaaaaaaaaaaaaaagaatcataggatcgtgcctattactcggttttataaaatgaattgttttcccctgaattcatatgttgaaagcttaacccccaacttgactgtatttagagatagagtctttaaggaggtaattaaggttaattaggccatacagttggggtcctaatctggtcagaatggtgtccatataagaagaggaagggcatcaaagaatctgtctctttctccacacaggcacagaggaaaggctatgggagcacaaagcaagaaagtggacttctgcaagccaggaagaaaggcctccccagaaaccaactctgtgagcacatcgatctttgacttttggcctccagaatattgagaaaataaaagtctgttgttaaaccacccaacctatggtatctttctatggcagcctgagctgactaatacccttggtaggtgggtggcagtcaccttactgggctacatgatgtgaagttaaagtaactttagcaataggcaccatgtaatttcattgtatagatattatgtcttttgcactgatattgcttttttagttgtatgtatattgatgcctgggcctagcattacaagaccagtcaaaatgggaagaaagaaaagaaggtgggaaagataccaagttccataattgcatcctctacccacatccagttcttagaatcttttctgctggaggctgcaccttgtgtacactcaaattcaatctgagcacacaatcatttaaacaaccaaggcaacttttccaattttcagcatcacgcgcttgaggaaacaagtatttcatcactaatttaatattcattgagataattgttctcaggttgatgaaaaatgtggtgtatccatttactgttgtcttcttctgggtgaagaatgttgcctttactctctagctcacatttgaccagaaactggagtcccagcaaatcttagtagccacttaggaagcctattttaagatattcccaatctcaaacttgttctaagactagtatgcttattgaggagaaagagcttcatgacaaaaattcaactagagctgtgggtgacagttgtgtgtttcagtgctggtctgggcccaggtttcccatgagcacctaatgaataggctcatttgcagagatcgtcaaggtgttcactatgtctctctcacagcctcaaaagaagtgatcggctaaaagaatttgtgtagtatcctgaagggaaattagtccagaaatagaggacaagataaggattttataaaacagacatgtgattcaacagttgtttaagatgtagaaagctgcaagagacagttgttcccactctaatgacaagaaaaagctgtatggtctgcaaaatcatatgtgttttgatcccaccagagagctgaagttgcaaggcccctgagtcagctgaagtccaaagcatgagaaacccccctacagaaggacaaacagatgaagcagttcatctttaacagataatggaaggaaaagatggaagccataaatgttggttggagaaaaatcactgaagttttcatcatttctttagttttttttttttttttttttgatacggagtctcactgttgcccaggctggagtgcagtggcgcgatcttggctcactgcaggctgcaccccccggggttcacgccattctcctgcttcagcctccctagtagctgggactacaggtacccgccaccccgcccggctaattttttgtatttttagtagagacgcggtttcaccgtgttagccaggatggtctcgatctcctgacctcgtgaaccacccgcctcagcctcccaaagtgctgggattacaggcttcatcatttcttaaaggccaagtgtgaactattgtgacagcttagaatctctgagagtcccagacacatagcctgttttgcccatttactgggtctttcctcccacgtacttagtgctgataagacacatgtagcagggaaagagaatttctcgagcttgccacagtggtgtaggcatataagtcatgaatgcatgatagagcaccaccagagcacaggcacaaaacgtggttgcttctctcacataaaacaaaaggcatctaccactgatgttggagctagaaacctgtccaacccttgcccccaggtataggccagctgctgaggcagagttagacacaaaagctgtctatactggacaaggggaggagacctgctcttgcccaagacttcccatcattgaaaggtagagttccaccactcccaggggatgtcataggaacactaggactcaggcacccatggcctgaggtttggtacacattcagtgctatcagtaatatgagttggtttcaatcgatcatttgagttggttgcagaccctttcctttagtgaggaaaaactgtgatgtgggtacaaagtttccacgtttaggaaagattggcccgtccttcaggatattatattgattggatttctctcaacctcctttagttgtgtttaccgttattaaaattcagtgacattcacttggatgaggtggtaataaaaacaagttgtgagaatttctagtgatttttgatcccaagccatgtatcactgttgggccttcatgtgtgtacttgaaaacaaaacatgtacaattgtcgcactggtttgaagattttaatggtgaaagcaacctaatcagtaatcagtactctatctagaaaccaatcttggaaatatgtgattatgctcttttaaaatagctgaaaagaaggccgggtgttctggctcattcctacaatcccagcactttgaggggccgagttgggcagatcactgaaggccaggagttcaaggccagaagcctggccaagatgatgaaaccctgtctttactaaaaacacaaaaatcagctgggggtggtggtgcacacctgtaattccagttactcaggaggctgaggcaggaaaatcccttgaacatgggactcgaaggtggaggttgcagtcagctgagatcctgctactgtaccccaacctaggtgacagagggagattctgtctcaaaataaataaataaataaaatagctgaaaagaaatgactctgtgtttattctcactttgttcttgttttgttgtatagtatttaaataaaagcagattatttatcctcatactgaatttccaaaactgatatttgcatttaacattttgttaaatgatggagagaaaatttaattgtcttactttgaaaagtttggcataggttctgtcacatttttgatgctttcaatcgcagtctgtcattagaatgctggcaactagttacatgcaaggagtatcctaaccactttaatacaatggtttgaagtgctgcaggcagtaactactggacaccaaatcacagtgtttttattggtgacatgttagagagaaatagaactttctgcagtacaaatgtcctattaacaaatccttgtgctattagcttacaggactttgactcctgggtctgaaaaaggcacctactcctgctaaatcttgaatattgacaccattcaatgcctcatcttcagaccctgaggaagacgacaatccaaatgaactgctttcatgagaaacagaacaagaaattgaaacaatttaatctctctagacccaacaatcccacctgcccccttttccacctcatgccccctcttcctctggacagaagagatgggcacatgacaatggtaaggccggagtctgagggataagtttagttcagagactttcttttctttctcttttcttttctttccttccttccttcctttttcctttctttctttcttttttttttttttttttttgcatttttggtagacacaatgtttcaccatattgcccaggctagactcaaactcctaagttcaagtgatccacccaccctggcctctcaaattcagagattttctataaattagacattacactcaggagcacactgatgcaaggccagcaactggccccgtgtatcagaataacagggttttctagagcgttcatctgatttttcatagaaaagtataaaaggtcatgaaaggtttttgaaactcttaccttatggtcaaactaattgtaattaaatttgtgtataaggttttattaaaattatctttaacattttaatacaccacacaaaggtaaaatttagttttctcttttgatcaaaatgtttgtgtaatattaataatagataaaatatttttgtttaccttttggctaaatgattgactattataaggtgacctgtgaccctattttgtgatatcaagtgtctcaaaactttgatatctggcaaactttctaagagtaaaatttctaaattcagccctttggacctcaaattaactttttggatattaggttcttgaagtccaagagagatatattaggcttcttaggcttatttgttatgtagaattatgcatgaagcattgtcaaatctgaggtggtgtttcacttcctttgggttctattgacacagatgtgttgttaatgtgtgttccaggattgtatgagattcctagagttctgatatgctgttggtaataattatgattattacgttaaattgttgtgtgccacagaaccaaccaaattcccttgtcaactgtatctttaactatggctgtcttaaggcttttgtcatccacaattgttgttttgctttgattcttctcaaaaagtgacttataatcagtcacagtccaggccttggttttttggggaagtccatgaaaaggactcttggatgcaggtttctgataactctggagatcgtgccattaactaaagagaaaatttccagggcactaacagaaaggctgatgtgttcatagagattgctagcccagtatgaagcaaagcaggagatgattgcatggattaaactaatggaggactgaaataagtttttatggcctttgtttgtttgtttgtttgaaacatggtttattcttcagagtctggagaacttttttccttttgagctatttatagcctgaaacaattgagtagaatagtcttctaaacagaatttgaggcatatttttctctctctgctgaatttctccagaatttgtaaactgaatattcttaattcatgacaatgtgtttatttgcataagttcaataagattctgttttcttttataacctgacacaggtggaggaattggtaattttcccagggctttgcctgaaatgtcattgtgaaatgttccagcaaagcccatttaggagagcctatgtgaacaatgattcttgctgcactttgtgtgggtaatcaggccaagtatatgggactgaagcttcttttgcaggtaggttggtcctgctgtgttttatcttagtggaaatggggaactggagagaggaaggttgtgtttcaggagaaaccatggtattagatgaatgtttgattcctgggtggccatgcggtcacccatggtgtggagctgcccaggatgccccttctccacatgacacagccagaaagatggatgaccagattccccatgattgaggaactgacaaatagaaagtggggactgaaatcgatgcaatagtcccacagacagtgtttttggatagatgtagaaatggacccttctagtcttaaagcttgaaacttacatttgttttatctgagttcattcctcaggaaaggaccctcagcctctcaaaaagcatcatagacctgaaactcagcagatcacagcatccagacaatgagatgccagacccctcactcatcataagtgcttcctcacccctccagttcctcttttcctactcacagttacgtttcttccctgctacataaactcctcactttagttgatcagggagattgatttgagactgatctcccgtctcctcagctgcagcacacagttaaagccttcttccttggcaatactcaatgtctcaatgattggctttctgtgagctgagccgcgggcctagaccaaacacctgggctttcagtaacaatacatgtacacttttaaagcctgcaattaatgggtcatgagatattgagaaattggaatgacatcaacttggccaattctgagaaaatacactgtgcttaaatgtcagggccccgcctcctgaccttgacagtatatggttgattttgagtcatagcaggtgagtatggcctggtttgagtgttttatagaaatatataatatggctgattgcatttattttaaatccaaaaaatttccatttctggtgagcaaattttgttaaaaccaaccaaacaaacaaacatagaagtatatgaacaagacaatgaatgattccctgcctcccaatctcatttgattgctgtcttctgttatatactacagggaagaagggggcaaggcacccaggatgtcccatgtcctgttttgacaatcatctggcctccttgggcaaacagaaaagaaggaaagcatcaagaaaataacagaaattttgcagaaatttcatctccggtctgggcgcagtggctcacacctgtaatcccagcactttgggaggccaaggtgggcaaatcacttgaggtcaagagttcaataccagcctggccaacatggcaaaacctcatctctactaaatatacaaaatttaaccaggcatggtggcccacgcttgtaatcccagctactggggattacaatcacttgaacccagcagatggaggtggcagtgaggagagatcacccactgccactgcactgcactccagcctgagcaacagaaggaaactctgtctcaatggaaagaaagaaagaaagaaagaaagaaagaaagaaagaaagaaagaaagaaagaaagaaaggaaggaaggaagggaaggaaggaagaaaagaaagaaagaaagaaagaaagaaagaaagaaagaaagaaagaaagaaagaaagaaagaaggaaggaaggaaagaaagaaagggagagagagagagaaaagaaaagaaaagaggaagaaacgaagaaaggaagaaagaaatttcacctaggcacaggaaactctatgacagaggcttcaggggctcttctctggccctaaactcgcagtggatttttgcctcattttccgaggtgcaaatgaaatgatagaagtcgatcaaaggagagggcagagagaaagcaagaaggatggctccttcctgcaggtccaccttcctggagtgttgcttgtgggataatagaaatgccttgacatgggtgggtgggaactattgctacttattaggaattcagacgcttctggcaaattcgcattgtgaggttccatggtgtaatggtaagcactctggactctgaatccagcgatccgagttcgagtctcggtggaacctttctgtttaattaggaaggcaatgccgtgttttactccctaaatggaatggggattctgctgacgttcagaagctctgcgctgcgggcctccgtgtcccttctgctcccgctgtctgagcctcgggatgcacgccgctctcctcatcccctcttcggtgttcggggtcccagaaaccgggttctcacagtggcccggaccacagggaaatcgccgaatcatccattcggggtcaaagagcctggaggatcccctttcagggccagcctcctggcacccagcaatcggaggcccggactcgccccgccagggacccagcgacccagcaagtcctcaccccctctcagggcgaccctaggcctcggggagaggtttccactaaaaaggctgccacctctcgatcctagaccccgagattcctttcacccgggaaatctcttaatcgcatcctttgtcattttggtaagtaaacggtggcgtgagaaattttgatggggttagctcagtcactggagattgtgtctcagtttaggatcggtggttggagacctaacttgggagtagcacttttttattcgcatggcccatccaattccgaatgttaatttattctgttcttcatattcagatttttatgccgaatttctagctcctacgtctctattgcgggccctaaaagtcgctgtttcactaagctttggaacctgactccgggaaatttcattctttcctcccaagatctcagccggaaagagagatccgcgcgggctgggagcgcgggttctgttcctcggccgccccggctgaactcccgcaggaccacggggaagaggagcctgagcagctctgaggggccagtctctgacggtggggctccccctcgtcccgtcaggaccctgccccaaggagaagacgccttagaacgctaccagagttaaaaatgttttctcctgcgcttcagagcacttgggatgaggttcctgatgggtcttgggagtgaactaagatgtcactccaggcgctcaggaccatcgctctgattttcatattttggggctgagagcggttacgaaggactgaaaaacaccgcagtctttgaggggctcagtttggaggacgagctgggggaggggggcggtgagaagacgccttcttggctccttggagtggactggcaggtaaggaaaaataaactccgtttccccttgcaggctacactgcagggcctgggatggacaattggacagtcaaagagtaacaatatttatgtagaggttggctgcatgcattaaaaattgttatccctacagataagtgtaggaagggaccacggcactgcggttcaccaccagctttgcagcatatgtaactatgaaaacagtgtatagtgcataaaaaattcattcctgttcacaaataattgatcacaaccagttacaggtttctttgttccttctccacttccactgcttcacttgactagccttacaggaaaaaaaaaaatcatttgtaaatatgatattgtttcagttgatcctcagcccgcccgttccccaccccctgaaagtagctggaataacaggtgtgctaatttttgtatttttagtagagacagggttacgccattttggccaggcagctctcgaacttaagaactcaggtgatccgcctgcctgggcctccctgaacctctctgctgggattacaggcatgagccaccccacttggccatcatttgtattttgaatttaaatattttgtagtcatcactcttcaaagattctgggttttgttgcatgtgcatgatgggattcaggacatgctactccaaagtataacatcttggggtattgaatattttatgctaaaggaatatgagtaaaccacagaagcaggaaggtcactgtcaccctccccctgcccttcttccctgaagtcgattgtaagactcttatgtgagaggtgccctctctgtacccagaggaaaggtgcatcctggagtgtgaagacacagggacacagagaagagcctgaacacagaggcctggccacattttccccagtttgttactgttagatcatacttttattgtcttatcatacttctccatgactatccattcttcaataaaactactgttaaaaaacaaataaacaaaaaactgaggtttagctgtttccatgggccttcattttctttggaaggcgctcctgtcacataaaacttacattaaacaaatacatatgttcttctcttattagtctgtgttttgctgtgagggtctcagcagtgaacctaggctgggtgaggaaaagtcatatttcctccccgacatgtacaaatgtcttccactgtaaagctataaaaattttattggggcagatgtgaagcaaaaaattgaatcattattcccctttggatgagttgaacagatgagctaataaactcccagttccccccagatagaaatacttctctagctcattccccgaagctccttgagggtcaaacttgttggagattgaggggccttcctgggatctcccagcccaggaggttgctgctggtgagaggattgctgcagtctccctgggagggtgcatggtcactggaaagtatcactgctataacttcaatacaaccggttttcatcacatctgctctttgtgcagtgttacaggcaaaatacaagagctaacatgcacatgagtaacacatgcacatcatcaactgtgcctgcaacccaaagtgctacatgtcacacacagttgatgagtgtgcgtatgtttactcatttagtccttacctcaggcagaggtcacgccatcaccttcatcttccatatgagaaaactgagatgcacaaagatgttaagtgacctgcccagggtcactcagccagcaaaggaggatttgaaagtgggaatttgaagtgaaggcagcctgtctccagaagacattctcagaaccactgtgtttatactgctcctaacaaaaccagccttgcaaaaattatgacagtgagaaaaacctgacataggaaaactatgactgtgaaagaaatctgacctaactgactgcatcttgcttctaacctctgagctgcccttgtccattcctgggcataggccaggctaactatgagaggagtttagttccaagtctaagtctgaaacagagatgattgcccattcctgagacaaaccccttcctttcttggggatcagacctccttagcaaagctaacagatcaggtacgagattggaaattatggctcaggagccatgcagccagaagccacatgattcctaagctccccaactgtgccttatataacagtattagtgtcaaacctaagatttgacagggtgttcaaggtatttttcagaccctgccttatgatggactagctggcacacccagaccggtaaactgtctcatcttgtcctgtggccctcacccagggactgactcagtgccataaacaagctctgacactgtgatttcatccccaacgcaaccaatcagctttgcccatttcctagccccctgcctgccaaactatccaaaaaaaaaaaaaaaaaaccctagtctccgaatttggggggaggcagatttgagtaataataaacccctgtcctggtccctcagctgcctttgcatttattaaattttttctctattgtagaaagcctgctgtgctcagctccattggcttttctgggcaaccagcaagataaacctagcaggcaattacactaataaaagaaaaacacaaatggtaagcatgcttgaaaagaaatgtaagtctgtatatttcttttgaagaaacacaaaaggaggaggaatgataagataggcaatacactgtcctaaatattttcatgattctcctgcctcccgcatttccttcttatcccaataactgctccccagaaaccttcaacttaaacatggtcctgccagaactgggtttgtccttccctttacattttcctctcacctgccccacaccccttccatatctaatctgtcctttcacttccaagtcattgagtttttccatttaaaaatatgaaagatacggaaagaagaagataaccagttatccatattagcaaagtactgttcacatatgtacatatttttcttccaaacaattttaaagttactctcatttaaaaaaaaattatacatgcttagcatagaccataccaccaatacagaaaaagtacagatacataaaatttctgatcacgttaagttcaaaataatttttgttaacattagggcaacactcattgagtcatgttcttctggtatatctacagagacagtgtatattttaggtagactggcccccgccccatgcacccataaaagaaaaaatagaacaataaagaaagctatatatatatatatatatatatatatatatatatatgagttatatattttatatatatatatccacatacatatatgcttttgtaaaattgagcttagactgtatttttattttacaaatattccatttaatagtgcatgaatttaactgaagacagagacagaaacacaaatgaaggaattcctgaactctcaatcacatttagagagacattttctaaaggaatcttctaaagctaaacgtacattaaattaagtagaaggcattatgatttgcagtggttttccttttttttgttttttgttttgttttgttttgttttgttttgttttttgagaccgagtcttctctgtcgcccaggctggagtgcagtggcacgatctcggctcactgcaacctctgcctcccaggttcaagcaattctcctgcctcagcctcccaagtagctgggactacaggtgtgcaccaccacatccagctaatttttgtatttttagtagagatggggtttcactatgttggctaggatggtctcgatctcttgccctcgcaatccgtctgcctcggcctcccaaagagctgggattacaggcgtaggccactgcacccggccttctttttcttttcttttctttttttttttttttagcatggcatcactcactctgtcacccagactggagtgtggtggcgccagctcagcttactgcaacttccacctcccaggttcaagagattctcctgccttagcctcccaagtagctgggattacaggcgcccgccaccacgcccagctaatttttttttttgtatttttagtagagatgaggtttcaccatgttggcccgctggtttcaaactccttacctcaggtgatccgcctgcctcagcctcccagagtgctaggattacaggcgtgagccaccgcacccagcctgcagcctgtagtggttttcttattactttttacaatcaaattgattaaggcattggttgaatatggtacaatgcatccatttcaagtttgatgacatgtctattactccaaaatgtccttttgtaccctttgtagtcagtcccctcgactccctgaacccagcaatcaatgatgtagtttctgtcactatacaggttagtttcacctgttctagaaattcagcttgatggcgccacagaggatgcactcttttcatcactcagcatgaggtttttgagattcaccaatgctatctcatgtttccataatttgtcccatcttcccctggaagaatatatcacaataggtccattcacctcttgatgcatatgaacggtttccagtttcgggactattgtaaacaaagctgctaagaacaagttctttttgtgaatatatgttttgtaaattccatttgtcattctttagtattaacttattttgtaaaaggatgtcaccttcacaagtgcaaaattcattcaaatgttttttgaaaaaagttgaggcctgaagcagcagtctacacaatttcctttcttatatttcataattaaggggaagaaactttatctgggatattatttcctatcagcaaatccttaatgtaagccacacacgatgctagctgtactattagactatcttctgtaatctgtgcaataactccaagaagtacttcatattattattttcctgtaacactttccaacttgaagcctagcaaattgaaggacctggcccaaggtcaaacagaaggcaaggggcagcgccaggactggaagaaggccttcccaaaggcagacagaagctcatgtctttgtcagaacctcggtatttctgatgcgcctggaagccaatatccaagccgttctcagccaccggattggtgggtccttttgctcagaaactcctcgatgaggaatcccaagcatacgttagtgatgacggtcccgaaacaagggacatttcttaaacattctaaaaacccttttgctcatcggtaacgcaatgaaagttgttttcggtcttgcttcatatattttatatttgagcaaggcaatgtccgctgttggggttagaagtaaatggctcgtcttcatcaaactagatcagtccgtaagaagtacggcttccactcgcagtgtcctgaacactcgctgggcgtcctgtgcgttctagccggttttctttggagccgcgggtttctgcaccgcgcccgggttgggatggcagaggcttctcgggacgtgcggatctatgagtgccgtccccagggtagccaccaggggacgccataggccttccttccgtggtcctctttgcctttttcgtttgggccaggtagtttctattgaccaggacattagagatcagaagtgggtggggtcagaaaacacaccctgggagaggctggcgaaatgcccagaacctccatcactaggcctggggttttcttctgtagtggaattcttgtgctcatgtagtgcagggacaaaaccaattagatacttctgggagttaaaaagagatgaatttacaatgccatttgagaaggggtattaaggaaacgtccgaatttgccagggtactgatgcgtgtctggtgcaaaacgcaggttgagagagagctaagtacttcctgtccatgaaggtgataagcgagggcctgaagagggacgggggaggacactggcgccagagatagaaagaggcggcttgggggtgggaagcatgggtcggggtgctatttagaaagttgcctggcaatggatgtgggatgtggaagcgagacatcaaacaagaagctgtcacttaaatgaaatctgaagaaagactagatatgtaaacggcaggagatagtggatccggctcctcataaaatttcccgctttatatttcagggaggatcgcagcgcattttcgccaagacaggtgagactgcggttctgacctgcgtgtctcgggatgaattgcgttagggcacctgggcgccggtagaccccttcccctccgcaaagtaagcgtgttatgtctacaacccaacgggaacactaagagccccaaaggccctgatttcttcccaaagaacagcgcccgtctgcgtagtttgtacctggctctaccaagtgagaacacattccccgctagcacagaaatcctacaaactcctgagggggctgcgcttagaagcagaggctgtgtaaaaggtgattgggggctagggaaaaacaagaagatttttacagagcgtgagaccccaagagaatggagactatggaccaatctctgcaaaaagcagcctcatgttgaaaggaaggagctgtgcggccttcgcgctacttagcttgtgttaaacaggaacacaacgcctgacgcttatttctccggcaggaacgacggcgacatgttacttcctgtttccctgccatccggctataagaataacacaccaccaccaagattatacagcaaaaaaaagcgagaagtagacctttgcataccaactgctttttgcactggaaaattcaggggaaagcgcgaacgcagtcccccactaccacaaattacgcagtcgagtttcccacagttggggaaatcgcagaggtcaacacatccggagtgcaatggataagcctcgctctggaaaaaccactttcatgatcatactatctcccctgccaggtaagtgtgagttcacacatctccgccctgcgacagctccatacgcctcaacctttacagacacggtcacttgccccgcgcacccgcacccccacccccaccccgccccatgccacccggagccctcctagccctgacacacagctgggactctcacgtccaaccagcggtcctggacttgctcccaaagcaggagaaatccttcgtgggaagcagcagcccctaagctgcctcatctacgtaggaatcgccctatccgtgatgtcaccgacagcgcctttcccggtccccatctgctcttccgcccgaccctccgccactcagccgaccaacccgctgcgggagccggcggaggaagtgaagtctacctctatctcctttccctcccttccccacccctggtctctcccaaagaagtaggttcttagcctgtgatgccaaggacccctttggcggccagctggagcctgggcgctcttctttgagtaatggcttttaatgcgcaaactagaaagtttaggattacaaagaaaaccggttcttttcacatacggttatccttgtgatgtaccattccgcttgacagtggaagtcgttcaatatcagagagaaacagtatctatgaaactagagaggctgctcagatgactgcaaaccagccatccttacttgttttatcactaggaatattataaagacggctgtccagtttcatcaatcttgtagggtttttttcaaatacagcaatgtacaaaaatgtgctgccccagcagagcacactggacactcaggcatggtgctggagtcgttttgccatctcttcactgccttctctagaccttagcgcttacctcatgttaacactttatatgctgcaaagacagaaacaaagtcatccaaatgtggcaaaaatattttggggaaattttatttcaggtatttaactgattacttttaatatgtaggcaacaacaccaaactctgacaatactccgcagacttattaatggtttccacccccgtctctgcaaatctatcaggcaagtttttcccgccctttactttcatataaactgagtcatacactgtgtagtgagttttggggggagtgttactgcccaacaggttcaccttgcctgctgcctagacagagccaattttttgacacaggggaattgcaataaagagttatttaaacagagctggctgtgtgggagaccagacttttatttttactcaaatcagcctcctcaagcattccgggaccagtttttaaggataatttggtggatgggggccagtgagttgggagttctgattggtcaggtcagagatgaaatcacagggagctgaagctgtcgtcttgtcctgggtcagttcatgtgtgggggacacaagaccagatgagccaggttatcagtctagctggtgccagctgatccactgagtgcagggtcggcaaaatacctcaagcactgatcttaggttttccaataatgatgtgatctccaggaacaatttggggaggtttagaatcttgcagccagaggctacatgactcctaaaccataatttctaatctcgtggctaatttgttagtcctgcaaatgcagtctagtccccaggcaggaaaggggatattatcatctttgtttcacagctaaaccataaactaagttcctcccaaagttattttggtctgagcccaggaatgaacaaggacagcttggatgttagaaacaagatggaatcagatcagatctctttcaccgtgataattgtcccagttctaatttttcaaaggcagtttcagaagcagaggcataggtttgacttctttcactcagtcttatgtctatgaatttttcaccttattcatatggttatttgtttctgtgtgtcttactttgtatgaatatacattaacttatttattcatttgactgttgttgaacatgttgacctaaaagaaagaggctgaagcacaaaacataatatagagtttacttgagccaacatgaagacagctgcctggaagactcacacccaaggaaccttggatctgagctccctttggcttttgtcacaagcaggtttttaaggtcaaaagcagggacagacagtaggctgatagaaaggtgcctgtcaggaattctcattggtttacagaaataacattgattggtgattggctttatgttgttaagttataggctatggggtatagtgtttggtgtggcattattaggataatttacagcgacttgaggcgatatcaagcagtttcaacagatgaatacatagctcaaaaggaaggaatggaaaggggtttctctctcgatttaacatctctctgggcctgatcatttgaaagggctcacattcctcagataaaaatttttttaagtcctcctctccctctccctcgtctccctctccctcctctccctctccccacggtctccctctccctctctttccacggtctccccctgatgccgagccaaagctggactgtactgctgccatctcggctcactgcaacctccctgcctgattctcctgcctcagcctgctgagtgcctgcgattgcaggcgcgcgccgccacgcctgactggttttcgtatttttttggtggagacggggtttcgctgtgttggccgggctggtctccagctcctaaccacgagtgatccgccagcctcggcctcccgaggtgccgggatggcagacggagtcgcgttcactcagtgctcaatggtgcccaggctggagtgcagtggcgtgatctcggctcgctacaacctccacttcccagctgcctgccttggccccgcaaagtgccgagattgcagcctctgcccggccgccaccccgtctgggaagtgaggagcgtctctgcctggccgcccatcgtctgggatgtgaggagcctctctgcctggctgcccagtctggaaagtgaggagtgtctctgcccggccgccatcccatctaggaagtgaggagcgtctctgccaggccgcccatcttctgcgatgtggggagcgcctctgccctgccgccccgtctgggatgtgaggagcgtctctgcccggccgccccgtctgagaagtgaggagaccctctgcctggcaaccgccccgtctgagaagtgaggagcccctccgcccagcagccacaccctctgagaagtgaggagcccctccgcccggcagccactccgtctgggaagtgaggagcgtctctgcctggcagccaccccgtctgggagggaggtgggggtcagccccccgcccggccagccgccccgtccggaagggaggtgggggggttagcccccctcccggccagccgccccatccgggagggagtttggggggtcatccctctgcccggccagctgcccgtccgggagggaggtgggggggtcagccccccacccggccagccgccccgtccgggaggtgaggggcgcctctgcccggccgcccctactgggaagtgaggagcccctctgcccggccagccgccccgtccaggaaggatgtgggggggtcagccccgggcccggccagccgccccatccgggaggtgaggggcgcctatgcctggccgcccctactgggacgtgaggagcccctctgcccggccagccgccccgtccaggagggaggtgggggggtcagaccccgcccggccagccgccccatccgggaggtgaggggcgcctctgcccggccgcccctactgggaagagaggagcccctctgcccggccagccgccccatccgggagggaggtgggagggtcagccccccacccggccagccgccccatccgggagggaggtggggaggtcagccccccgcccggccagccgccctgtccgggagggaggcgggggtgtcagccccccgcccggccagccgccccgtccgggaggtgaggggcgcctctgcccggccgcccctactgggaattgaggagcccctctgcccggccaccaccccgtctgggaggtgtactcaacagctcattgagaacgggccatgatgacaatggccgttttgtggaatagaaaggggggtaaggtggggaaaagattgagaaatcggatggttgccatgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttgaatggattaagggtggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttatctgctgaccttccctccactattgtcctgtgaccctgccaaatccccctctgcgagaaacacccaagaatgatcaataaaaaaaaaaaaaaaaaaaaattttaaaaatctttcttcttgaaagcattgatgatcaaaagctcagtcaaggtgtccctctttgccagaaaggctcattcccagatagtcctatcccaggcaggggacagggaaggaaaggagccacctcaccaaggaatttttaagaatgaccacaagtccaattgaaagggcattacagccagacacggtgactcacacctgtaatcccagaacttcaggaggccaaggtgggtggattgcttgagtcgaggagttcgagaccagcctgggcaatatggcgaaaccccatctccacaaaaaatacacaaattagccaggtgtagtggcacacaccttagtcccagctactcaggaggctgaggtgggaggattgcttgagcctggaagttcaaggctgcactgagctaagatcacaccactgcactccagcccaggtgacagagtgagactcagtctcaataaaaaaaaaaaaaaaaaaaaaaacagaaagaaaagaaagaaaaagggcatcatagaatggcaaaaaaaaaaaaaaaagagagagagagagagagagaggcctcagttaagtctatagctgttgtcacctgttgaatcatctctagtcttcagaataccatgaaattagttttctcagaagtaaaacgatgagaaatacataacaataatgacattgcacttcatcattccatgctcttagacatttatagggccatggatggtgatcttttcaagagacaaaaataaatgctggtgcagaacaggtaagtgcgctataatttgagtacatcagcttttgagcatttaaatcatgcatcagaaatttagagcaagagggcaggttggatcctgatagcaggagtgtttttcttttaactttccagtagcatcatggtgtttaccactgtcatttcagagtgacgtgacaattttttgtttgattttgtactttttatttttattataattactttttgagacagggactcactctgtctcccaggctggagttcagtgcaagatcacagctcagtacagccttgacctcttgacctccaaggctcaatggctcagcctcctaagcagctgggattacaggcacacaccaccacacccagcttatttatttattttttgagacagggtctcactctgttgtccaggctggagtgcagtggcatcatcagggttcactgcaggcttgaactcctgagctcaagtcatcctctcacctcatgctcctcagtagctggactacaggtgggcaccaccacacccagctaatttgtatatattttacagagtcagtgtttcaccattttgcccaggctagtctcaaacccctgggctccagtgatcctcctgccttggcctcccagagtgctgggattacaggccgttattttgacaatacgattatgatgggttaaactgagatgtgaggcaggaaggttagggtgagtcacatagattcgataagcaggttttgcttgatatgaccctgagttgcatcgtgagtgcaatcaggaggaatacaggtgaaatttagcacaggatgtaccaacgggccattatggccaaaagtggttggtggtttaaggtggcaaacccagcaccttgttaaatttcccacagtgcaatggtttgtgagattctgatcagagaattatccctccctgctataatcaaattaattagggacagtgaaacagaaatctgatcataggcattttgctatgtaggtatgtatatgtatatacacatacacgcaataggactagtgtgtcatatcttaagagaatacacatataggatgattttaccaaaaccaccaagagaggacccctacaacttaagggagccctagtggtgtattattccagtcaacagaaaaagagactcaggtgcagtgagcactggaactgtattgttgatacaggccagtatcttgggcaaaagcggactacaacagatgtcagctacttgccatctcggtcaggaagactgagttacctttaagtgaaaatctccactaacagatgtccactctggcagtgctgccttttacaaaagaaacatgaatccgtgtgtcaacgcccttaagtttactggcacagattgttcagtaatacctgttgtgagttgggtacattggcccatgcctgtggtcccaactatttggaagattgaggcagaaggatggcttaagcccaagagttcaaatctacagtgagtcatgattgtgccactgcattctggcttggggaacagagtgagatcccatctcaaaaaaataacataaaataataatacctgatgcggtcccttctaacagtcttgggaggagtattttatttgatgttgtttccagtaaacaacaacatctccaggttataggccaagatttttgatattttcatctcccaagaattcattatgaaaggaatcctgtgttaatgtagagtttttagtaagttttgtgagatcttagcagtaatggagaatgtcacctttgagaagtgcatattcataagtgtcttcacctaaccactgcatgggtcttcctgttattatttcaaagagagagagtgtggacattttccagaactagtgggagatccttggccaagaaaggttaaaaacttctgttagctttgcctatggagtttttattgtatcatcagtgcattccatcagcccagaggattaggagtgataggcacaatggaattgttgggacatagacaaaactgtacaaatggatccaattacctgaccgatgaagtgtgttccttggttgctatggaattcagatggcactctccatgaagaattaccttttctaatcacaatctactaacctactacttgggctgtggctcatcggcatggaaatgctcaccccagtgagcacatacaaattagcaccagaaggtatctgtaaccctcagatggagacagctggataaagtctaagtgctatgtctcaaagggtcctaaaggtaaaatgttcctgtgacccatgaagtggttttccagggttatgtttgggacagacagtatagcaaaaataaaccttttctactatcataggcaatgattttcaataccattgctttccccatgctaacattttgtctgaattccaataagtcagcttatgaagtactgtaaaaagggtgactgaagcctaaagggtggatcagtgtatcattgggcccataccatatgcctgtttctggaagaaacttgtttcctttatccttccagagatccctctcctgcttgggagctcccacttatgcttcttcttctgttttttttttttttttttttttttgagccagagtctcggtctgtcacccaggctgtagtgcagtggtgcaatctctgctcactgcaacctctgcctcccaggttcaagtgattctcatgcctctgcctcccaagtagcagggattataggcatgtgtcaccacaccggctaatttttgtatttttagtagagacagggtttcaccatgttggccaggctggtctcaaactcctgacctcaggtgatctgcccgcctcggcctcccaaagtgctgggattacaggcatgagccaccatgctcagcccacttgtacttctaaagaagtcttcaatgggtcataagtcagcaaggtcattttgagaagttctgtgtctgatgtcaccttcagagctgcattcttagctgcagcgtcagcaaaatggttgcccttgctctccggaatatctaattttgaatgaccaggaactcctttgatgatggccaaagattcaggttttcaaattgcttctaagaggtcagagacttactggtcatttttcatggcttgaactgatgaaatcagaaacctatgttgcttctaaagcattccaaaatcatcacctactccaaatgcacctctgctgccagtgtaaatgttaggctgaggtgagaggattgactgagcccaggagttcatttaggtccagcctggaaaacacagcgagacctcatctctagaaaaaaaacaaagaattagctgggcattgtggcacgcacctcagctacttgggaggctgaggtgggaggattgctagagctgagagattgaggctgtggtgggccatgatggagccactgcactctagcctgggtgacagagtgagaatctgtcacaaacaatcaataaataaatctcaaccgtttaaaatatcaatgacagatttgcttggccttttaagtgcattgctgaattctccaatctacatttttaggaacaacctggggaatggcaacatggaggtatttggccaaaatgcagaccctttcattgtctgcttcagtctgtttttaagaatcctctaaaggattattccaatttgcccttttcaaccatttaatggccctgccttcttaccccagcatgtgaattaattgataaagatcagaatgtccaggctcaaaagtttgggcaattaagtcaaattacctcccaaacactataggatcttggaggctgctttagaattagaaggggaaaatgtatttaaatttcaatcagggaaatcttttttttttttttttttttttgatatagagtcctgctctgtcacccaggctggagtgcaatggtgcaatcttggctcactgcaacctccatttcccaagttcaagtgattctcctgcctcagcatcctgagtagctgggattacagtcatgtgccaccatgaccggctaatttttgtatttttagtatagatggggtttcaccatgttgtccaggctggtcttgaactcctgaactcatgatctgcccacctagtcctcccaaactgctgggataacaggcgtgagccactgcacccggcccagggaagtcttttatgatattcttaattcacattttggtgaagcagtatacagaatggtaggctcccttcttcctgtggattttaccttgaaaggggctgtcagaacagaagtttcagggaagggaccagagccctggggactttccttaggtgatggtgatggaagaagaggcaaggcaggaaaggagggctcaggtaagggagactatgcaggtacaggggcaggagaagaaggagcagttgggggcgaaagagacaaagcctcctcaatatttctcagttcagaaaacatgtcagtttagctccttcagcttacttcctcactggagataattttctcagttcttttagaaatttctaggtataattggaagtaagtctcccatttaatttggttctaaaaccaaatttttccaattgtgcacactaataaattattttaagcatttcaaaatatccccattttcttcattctgcttatgatttttcctggttaggtgggtccagtttcttggatatttacaagagaatgcctcataagtgttatacataaacccagctgatgtttctaaaggtggttgtttcttcgcagtgtgctaaattttgaagcttgatttcccataattcaggagcttttcagatgaccaaggcctgcgatgtgttttgggtcacagtgtggtgcttatgaagtcactcctacagataacaccggagttgtgtattgctgtctcagtggttcccactgtttctaaccaccaggtggccacagagtgcatgtgctatgagggacccatcccacatatgccctcccagaagagcaggaaagggggttcataaagatgttcttctgatagggagtgccctatgaggccaccttcacatggtgagtaatgaccccgacacctctgcaacatccccgatcacttggagcacctgaatggatcagcgggagcagatcacttcttttcttcagggcaagggaacacacctccgtgcactttccagttaagaacaggaactagtcacaaatgaaaagctaagtccgaatgttcaaaacaacatgctacataaaacgaaaccaccagagcatacctgccaataccttggcccagatcttcctgctgaggaacagaggcagaaaaggcagaagctctctggggagctctttgcctgactgtgacccaaactttctgtcctgacgcagaggtggaaaaggcagttatttccccctgaaactcaaatctcttactcacagggtaaagacagaaaacctccgttctagaaagggagagctggaaaggacactcaagcaaactccaggccttcaaccaaagagtgggaaggtccagatttcaggaggattcaccacttactactgcccaactctttctctcagagtcagaactcaagggcttcagatctggccaggcacccagtccaggaggaatgtggtgtgatctgagagatgaaaatacatgcccccttagagactaaggcagactcgaaagttaaggaaacaaaagttagctacttgtccagggttcagggctcatctggcatggcaacttcctgaattcctatggctacaggaaaaaccacactcttgctaaactccttaacaatagaactagcaagcaaattgtcaaaaccttcccagcccttctcaactggatttacaacccagatcactagacctctgatgggacagaagagtggccttccattctctcctgataagcaactgcggatatcaagccagtttcagccatgttacagggactgcacacaaaccgacttggtgtccagcagttcaccttttgacataaaaagccaatttccaccttattttaatgctaaaatcccttcccaatgtgaagatggggtgcatgttacatatatgtttaccctttgcacatgagctcaatacccctcagaaatggcgtttctccaaacctgctgaatatgtataactccattgtgtgatacacaccctgtgaggcactaaaaccaaactgccctctctctctctctgaagagaaagcaccttttcaaagacacacaccagagactgtctcttcctggactgcaaactgatctcaccaatgaaattcttactactatgtagccaccctggaggcctttgagaggatagtcagatggtcagagatgagttgctctgaatcctgctcccagggccaaaaacgtcaacctagaaggaaggggcttaaacacaaaatatgatttaaagagtttatttgagccaatgtgaggatagttgcctggaaggctgagacccaagcaatcttggatatgggttctgtttggcctttgttacaagcaggtttgtaaagaccaaaaagggagacagggagttggctggtagaaagttgcttatcaggaactcccactggtttacagaaataacattgattagggattagctatacattgttcagctacagggagtgagagatggtgtccagtgcacgtgattaggttactttatagctaactgtggcaatagcaagcagtttcagtggatgaatacatagctcaaaagtagggaagtggccagtggcactggcccatgcctataattccaacactttgggaggccgaggtgggcagatcacctgaggttaggagtttgagaccagcctggccaacatgatgaaacactgtctctactaaatatacagaaaaaaaaaaaaaaaaaataggcaggcattgtggttcatgcctttagtcgcagcaactcaggaggctgtggcaggagaatcacttcaacccgactggaggaggttgcagtgggccaaaatcctgtcactgcactccagcctgggcaacagagtgagattccatctcaatacaataaattattttttaaaaaaatttaaaaagcagggaagtaggatgtggttggtgtttcattttaatgcctagctctaggcatggtaacttgaaagcgcccattttcctcacatgaaaaagttcttttctttcttttcttttctttttttttttttttttttggagacacactctcacttactgtgccacccatgctaaagtgaagtggcatgatctctgttcactgcaacctccacctccagggatcaagcgattctcatgcctcagcttcctgagtagctgggattagaggtgccagccaccatgcctggctaatttttgtattgtagtagagatggggtttcaccatgttggccaggctggtctcgaactcctgacctcagatgatccacccgcctcagcctcccaaagtgctgggattacaggtgtgagccaccatgcccagccaagaccattaatttaatctacagctaaatctattatattttcatgttacaaattcagcaagaaaagttttccctaatgaaacatcacatttaaagcataagtagttaaaaaaaaaaaaaaaagtaagagacagggtgttgctgtcatccaggggagagtgcactggtgcaaccacagctgacaaacctggaaattctgggctcaggctgtcctcccagctcagcctgaattttaactttttagatgtgacatcttgtcctgttgcccgggctggtctccaattccttgcctaaagcaatcctcccacctcagcctcctgatttgctgggattacaggtgtgagtcaaccagcctggcattgcaaaaaaaaaaaaaaaaaaaagtcaagaaattattcttattctttattttattttattttgagttgaggtcttactctgtcacccaggctagagtgcagtggtacaatgatagttcactgcagcctggatctcctgggctcaagtgatcctcctgcctcagcctcccaagcatctgggactacagacgtgagccactgtgctgactagtttttcttttaatcagctcattttttaaaatttgtagagacaggcgtctcaccatgttgcccaggctggtatcgaactcctggtttcaatccttcttccctcctcagctgcctaaagtgctaagactacaggtgtgagcaccacgccctgcttaattttcatattttaattttatatacgtaattattactgtccttaagataactggggcagtaatctccttaaagttttagagacttaatttatctgttcactccactggaagagtatgccaattggtttcataagaagatttatttataaatcagaaaaattctttccaccaaactaggggtcattcaaaagcaaataattgccttaagtaacatcatttaaggtgaaaacagatgcagtggtatctattaataatgcttctcagtgtgggaaacaaactgaaaaaatgaacatcattagatccttggaaaaccctcactgctgaaaatctgagtaattctgtgatacccttttgagtcttccaggacattctctttccggagcacataaaagtgagtaaatcatttttcatccattttcattaagagctgaacttccttgatgttctggagattattaaatttgatttgtggccaggcgcagtggcttatgcatgtaatcctagcactttgggaggccaaggtgggcagatcacttgagttcaggagtttgagaccagcctggccaacatggcaaaaacccatctctactaaaagtacaaaaattagccaggcatggtgttacatgtctgtaatcccagctactcaggaggctgatgcacaagagtcacttgaacccgggaggccaaggctgcagtgagccaagatcgtgccactgcactccagccttggtgacagagcgcgactctgtcttaagcaaaaaaaagtttttatttgtatagttgtgagaagtgcttatattgctgactccattgcttatttgtgatcatataaatctcttttcttctttctctagtgtgatttaaacttaatccttaaagaacatgtatttcagctggttagagttttttagctagtagaaacctgagtatatgaatcaaagaaaactgctccttacatgccacagacttagttttctttctttctttctttctttctttctttctttctttctttctttctttctttctttctttctttctgtactaagatttattttaggtatagtaatttgttaaagccaagagctcctatggaatgaagttagatgggaggggggcattgagtagtaaggtcatccttataatagagatgccactcttgcagatattgacagctattgggcccaaaaaattgtaaccaaatgttggaaagacaagatatgagcaacttctgattgctgcagtctcaaatatcaagaaataccgttatcctcaggacaatgaatacacaatcaaaaaagactcacagactagattagctgtcatgtatcatcaaacagggactggatccttgtcaaacaccacccaacagagattgtccccagaaattcacttcataacatcaaaaccagaaacccacattgatgccactgatggcagaaatcagtgatgcaaaaatgagagagagagaaagagagagagatagaggaaggatttgtccaattacaatgcttagtatataaaagcaaatgagatcaatttttgctcatgaacacagaagaactgagggaacaagagccaatagctctaaggatccaagtctgcaccaggggcctgcaggattctgttggctcccatgatgggtctcagatgggctaatttttatggacatagcctctgaaaaaaattagtcaagaaataatatacagacacttatctgcatgcccattctccattaatatagaagggaaactggcattagatggttttcatcaaataaaagtaaaatcaagatttataaataaaagaggaaagaggagaaaaaaatgtctgggaccattgtgattttgctccctttggataagtgacttggcagaaggctgtcaaagaggtcactgtgacctgtcttctctggaccaatgtgacttggtcaccacaggaaacaattacaggctgggcacagtggcttatgcctataataccaacactttgggaggctgaggtgggcggaccacttgagctcacgagttggagagcagcctgggcaacatgatgaaactctgtcttggagagcagcctgggcaacatgatgaaactctgtctgtacaaaaaatacaaaatttagccgggcatggtggtccatgctagtagtcccagctactcaggaggctgaggtgggaggatcccctgagcccagggaggtcgaggctgcagtgagccatgattacaccactgcactccagcctgggtgacagagtaagaccatgtctcaaaatacataaattaaatttgaaaaagaaacaaggccaggcacagtggctcatgcatataaccccagtactctgggaggccaagatgggagtatcacttgagctcaggagttcgagaccagcctgggcaacatagtgagacctcatctctaaaaactacatacatatatatattaataaatatgtataataaaatataatatataatcaaatatatacatattatacataatatataattgtatatatttactttcagataattataataaaatatgtatatattttattatatatacaataaaataaaaaagaaacaattacagatgttggaggagtttaaaatatctcagccaggtgcagtggttcaggctggtaatcccagcactttgggagactgaggcaagaggatcacttgagcccaggaggctgaggcttacagtaaactatgaccataccactgcactgcaacctgggcaacagaaaaagaccctatctcaaaaagtaaaatgtcttagaagtttagctgtccatcctatgcaactgaatacctgtgtgtgatgtccaccatgtcctcctgttgtacctcccccttacttaagccaggaaggcacttgtcccgttattagaatatcattggcacatggccaggcgtgctggctcatgactgtaataccagcatgttgggaggctggtcaggagtttgagaccagcctggccaacatgatgaaaccttgtctctactaaaaatacaaaaattagccaggtgtgatggtacaggcttgtaagctgagatcactacaatgcactccagcctgggcaacagagcaagactgtgtctcaaaaaaaaaaaaaaaaaaagaaagaaaataatattatgggcacatatatagaaagtttgttaagccgggtacggtggttcacacctgaaatcccagcactttgggaagccaaggcaggcgaatctcctgagcccagaagttggggttcctggggccaacttgggcaacattgcaagaccctatctaaaaaaaaaagaaagaaaaagaagtaggatttgatggtgcacatctgtagttctagctattctggaggatcactagagccggggtggcagggatgggcggtgagtttgcagtgagctgagatcacgccactgcactccatcctgggtgacagagcgacacgtagtctcaaaaaaaaagggagggggggggagaaaatctgttgtgtcggcaagtaaatgaagaaagggacgttattagagttgagaaataaattggaatatgatttggtacctttcccacagaagataagtttgctaaatgtgctgaaattagaagcattatataagacccggtgcagtggctcatgcttgtaatcctagcactttgggagacctcggaggtgcctgagcccaggagtttggggaccagcctgggcaatataatgaaatcctttctctacaaaaatacaaaagttagctaggcctttcggaagcgacaactgattgtgccacagagacacaaccctagtggcttaggactctgggaagatataatctcccccacttatctagtgatcgataatgcacgaacgctttaaaagctggagcaggcggctgggcacggtggctcacacctgtaatcccagaactttgggaggccgaggcgggcggatcacgaggtcagctgatcgagaccatcctcgccaacaaggtgaaccctccctctctactaaaatacaaaacattagccaggcagggtggcgtgcgcctgtattcccagctactcgggaggctgaggcaggggaatcgcctgaacctgggaggcagaggttgcagtgagccgagatcgccctactgcactccagcctggcgacagagcaagactctgtctcagaaaaaaaaaaaaaaaaaaatctggagcaggcttggagcagcagccgtccctcagtgggttctagccaccaacctttagattaacagccgaacgctctaaccgattgtgccacagagacacgtagtgtaccttcttctgggcgctataggaagggtgcactcaccaaacattccccaaccctcccatcctcagagcccaccagacagtaggactgtgcaaggccttggaaaaccggagagattacagcggtgaattgtgttggtctcgttggagacccgcaggttgggagattctggaaccaggacgaccttgcccctagcctgctttagaagcccccggaaacgccccggccccgacccggacctgagccacctgggggcctaagggaagctgaatgcccagtgggctcccgggatggctcttcccgttctttgcgcagccttcacccagtgagggagcctgtgcccaccctgcccagtcactttcgaggccgctgcggaacttccgctgccatcttccgatcctgtgtcccgcactgggacacagagcagggattgtggtgagggtggctcgtgggtcctctcgcggagagcagggtctggcacttaccagcgcgcacgactaggacttgttgaattaatccattgcccctttagcttttagtcctttgaagggccctgaaaatggaaatcatgaaatatttttccacggggaagttttgttttgcttttgagatagggtctcgcttggtcgcccaggctggagtgcagtggtgcaaacactgctcactgcagcttcgacctcccgggggccatcgtcgcctttagcttttagtctcttgaagaaccccaagaatagaaatcatgagatttttccatggggaagttattttttcaaagggtctattcacgttgatttctcagcatcccctggggcgggcaacgggcagggcctccagtgcacctttctgccgcggtggagccgcgggggctcagctgggcggtggtagggtcctgaggcagaagggcaggagcgggggaagggaaaagtaaaagcagggaaagaagccggggagcggtggaccagacatccagacctcccgaaggcctcttgcagaggcacaggctggatcttctggaggtgagaattgttttttgttgttgttgttgaagcagaatagggaggaactgaggggaaaattgagagagaacacggaatagctccaaacgcgaggacctataactcccaaacaataacatcttccagaagaactagacagaaaactaggcatctgggaaccctgaaatcccaggagaagtagcatcatcatgaccctctgtgttccttttggcaaaggacttgcttcgtttgtacaattgtttgtgtttgttaaataaataaaacccttttcatgtatctttgaaagtacattggctctattattttatggttacaaataatgctgcagtcatcattcttgtacacttctcattggccactggtgtatttctatagtgtagaggcctggagagcagttgctccagcatagtgtttacatggtttttatatcattccattttctttcctttcttggcttattatctataactgtttctttcatctggtccaccgctccctagcttcttttcctgcttttgctttttcagtgatggctttcgggtttccagaatacatcttcatcagtgccatcaagtgacattatacctccccttctggccattatgctagtgttgtcatgtaatttgattttagacatgttacaaaccccagaatccattattattgcttttgtttaatcggtcaaattattttaaaagatttatataataagaacatatatatttaactatgtacataccaatttccagtactctccatttctttatgtagatccagttttctgtctggtatccttatccttaggcctgggggactccttttgcatttcttgcagtgtgggttgctgagttctttcattttttgtatgtctttaaatgtcctcatttcagtcacattctggaaagatttttcatttcgacatagaattctaggaaaactttatttctttcagtactttaggatgttgccactttgtttttgtaaaactggcataaagtgggcttcctgtacttgttatacaatttttggaatgtgtatttaaattaaaaacattaaaatgggctggacgaggttgttcatgcctgtagtcccagcactttgggaggcgaacacaggaagatcaattgaggcccagagttggagaccagtgtgggcaagatagcaagaccctgtctctcatacacacacacacacacacacacacacacacacacacacacatacgtacatacattgtgaatgtcctagattcatcttaagttccaccaacagtgcacttaaagtaaaatgtgcccaacctgagggtcaaacctaactgctgatgtgcagtctgtgtttgtgagacattctcaacagcatttgctttccctagcatagcggttttcgtgttttcctcatacctgaatgtcttaagtgcaaaacctgtcagaaatcatttcctttgccaaaagattctaaaatactttttttttttttgagatcagctcactgcaacttccacttcccacgttcacaggattctcctgcctcagcctctggagtagctgggactacaggctgccgccaccatgcccggctaattcttttgtatttttagtagagatggggtttcactgtgttagccaggatggtctcggtctcctgacctcctgatccgcccgcctcagcctcccaaagtgctgggattacaggcgtgagccaccatgcatggccaaggtttgacttttatacactcttctgaaagggggggttggctagtttgaattgcgtcgcgggaatttgctggcgcaaaactcgctgggcaggctagagggcttacagaagcagaaagaaggcagttaatcaaactgacaggtcttgcaacgcaagcatagctggtgaccttgcagctgcactgaagggaagtcaggaacttacaaaaccagaaatggtaagggggaaagagaaggtagtaaaggcatttgttgttttttcctcttatccttatccgtgctaggggcggactgtgtagacagagtctctggaactcattccctggggctctgtcttttcagacagtgttatcaaggatctgctagggctctatctattgctggtcttggagtaagtcaagtactgtgaagctcagttatgcagttgagcttcacacattaggggaaacaacaagagaacagcacatctggagtgcaatggatgagcctcaaacttaggacgaatcactttggtaaccataggatttcccctgccagataagtggcagtccacatacctccgccctgccacagctccatatgcctcaccctttacacccacggttacttgccctgagaaccacccccgcctatccccaaccaccccaagcccttctagccctaacacacagctgggactctcacatccaccagcggtcctggacttgctcctacagcacggggaattctccctggcgaagcagcaaccctgtgctgcctcatctacacagaaatgccctatcggtgatgtcaccgacagtgcctttcccagtccccttctgttcttccgccccaccctctgccactcagccgaccaacacgctgccggagcaggcgggggaagtgacgtctgcctgtccctcctttccttcccgccttgtcctttggggaggtgcgccaagaccctgcatctagtctctcccaaagaggtgactacttaacctgtgccctgcggaggaaccttttggcggccagctggaagcctgtgcacccgtcttcaaataaaggcttttaattcgcagactagaacgtttaggattacaaagaaaactggttcctttcaaatctggttatgtttgtgaaatagcattccgcttaaaattggaagcccttcaatatcagggagaaatcatatctatgaaactagagaggcaaaccagccatccttactggttttaccagtagtagtgttataaagaaagttgtccaatttcatgaatcttgtaggtttggttttttgtttttcaaatacagtactgtacaaaaaggaagcggaatgtggttgcagtcttaatgtaatgcctctctgggcctgagaatttgaaaaggctcacactcctcataaaagttctcttcttcgccgggacggacagtggctcacgcctgtaatcccagcattttgggaggccgaggcgggtggatcacctgaggtcaggaattcgagacctgcctgactaacatggtgaaaccccgtctctactgcatgggaaatatttatgtatatgcaacaaaaggtatttgccaccacacatacatctccctgctcagctaaatatgtcatctaaagtgatgtgattatctagtacaaccttagccagtgaataaatagctttttattgagctgcaaaagaggctgcagtttcaacagcagtgtttttctttctttttctttcgaagacagtgtctggctctgtggcccaggctggagtgcagttgtgccagcacagctcactgcagcctcgaactcctgggcttaagtgatcctcctgcctcagccacagagtcactgggattacaggccagagccaccatgcctgattttcatcagcaatgtttcctgaggttacagaaagatttgtaatcctgggaggaaacagtcccctgaagcaaagtgttctcccccaaaaatgcaaagagctatcttcttgatagcgaggcagataattctcaggttttgccccacagaatctctatctaaaatagagcagtggtcatgactagtgaaaagtttgagggaactcacccaatgttgggtttcttcagaaatatatatatatttacataaatatatatttatatatatatataaatatatatccaaatatcctaaaagacactgcccttcatcattccatgctgttagacatttataggaccatggatggtgatctcctccagacaaaaataaatgctggtgcagaacaggtaagtgtactataatttgagtacatcagcttttgggcattttaaaccatgggtcagacatgttagagcaagggaccaggttgatagcaagagggagtgttttccttttaattttccaatagcaaagtgatgtttgccactgtcatttcagagtgatatgacaatttgttgttgttgcttggttttgtggggttttttgtttgtttgtttttgagacaaggtctcactgtcacccaggctggagtgtggtggcatgatcagggtttacttctgccttgatctcacgaattcaagcaaacctccttactaatcctcccaagtagctgggactacaggtgcgtgacaccacaccctggggtgtgaactgggatttgatgttttcagttggctccctaatggaataggttcctttactattctggaatacagattgtcattctcgtgtgcattatatttctactaccctgctaatttttttctttttttttttttctttttaagatggagtcttgctgtgttgcccaggctctattgcagtggcaggatctcagctcactgcaacatccacctcctgagttcaagtgattcttttgcttcagcctcctgagtagccacccggctaatttttgtatttttagtagagacagggtttcaccatgttggcaggccagtctctaactccttacctcaagtgatccacctgcctcggcctcccaaagtgctgggattacaggcatgagctaccacgcctggctctcaaaccattttgagtaagcaaagacagatatgtctggctttttagtacgttgctgaattagcctccaatctatatttttaggaaggacctggggaatggcaacatggagatatttggctaaaatgtgaacctttcatgttctgcttcagtctctttttgaaaatccttccaatttgccttttgcaaccagttagtggccttgccttcttcaccatcatgtgaattaattgataaagttcagaatatttgggctcaaagatttcaacagttaagtcaaattttctgccacaccctgtgggatcttggagcctgctttagaaacagaagagcgaaatgtatttaaatttagatcagggaagtcctttataatcttaattcacgttttggtgaagcggtatacacaatggtaggctcccctcttcctgtgggtttgggttttaccttgaaaggggctgtcagaacagaagtttcagggaaggggccagagctctggggactttcctcaggtgatggtaatggaagaagaggcaaggcaggacaggaaggctcaggtaagaaagactatgcaggtgcaggggcaggaggaaaaggagcagttggaggcgaaagagacaaagcctcctcaatatttctcaattcagaaaatgtcagtttacctccttcagcttatttcctcaatggaggcaattttctcagttcttttagaaatttagaaatttagaaatttctaggtctcattggaagtaagtctcccatttaatttgtctggttgtaaaaccaaatttctctcccttttttttttttttttttttttttttttgagacatggtctcactatgtcacccagactggagtgcagtagtgtgatctcagctcactgcacactgcactcactgcttgctgcatgacagccagtaagtccagggacaaggtgtaggggcagggaaggtgactttattccagagagccaccaaactgaagagatggtgaacaaatattctaaagaaccatcttaaattaatatgattttcaggctccttgtacgttagggaagggaggaagaaggaggtggttgaggtgaagaggtctgacaatgacagacttatgggctgcagtgagagccaaaggggatggtgaaaattctttgtcttttgtcaggtcacaatgctcttataaatcttcaacataacactgttacttgtgcatacaacctctttatcttttcaggagtcagtttggggaagggattatgatcatctgtgttttaaagttaaactgtaagctaaatccctcccatagatagctcgggaggggcctatctgcagaaataaggaaaagcagttggcctgaaagatatcaccacagggcaggaagggttaggagcaaaatgcagttagtcatgctaagcctccttttcattgctatgtatttaatttacttgaacacataattttaattttatatatatatatatatttttgagacagagtctcactctgtcacccaggctggagtgcagtggcatgatcttggctcactgcaacttctgcctccctggttcaagcaattctcctgactcagccttctgagtaactgggattacaggagcccacaaccacgcctggctaatttttgtatttttagtagagacagggtttcaccatgttggccaggctggtctcgaactcctgaccttgggctcccaaagtgctgggattacaggcatgagccactgcgcccagcctaactaagatcattaaaccattctaatttgtcaaaagagtcacactgatttttgaaaaataatgtaatgggctgggtgcagtggctcacgcctgtaatcccagcactttgggaagccgtagagggcagatcacaaggtcaggagtttgagaccagccggaccaacatggtgaaaccccgtgtctactaaaaatacaaaaattagccaggtgtggtagtgtgcgcctgtaatcccagctactcaggaggctgaggcaggagaatcacttgaacccgggaggcagaggttgcagtgagctgaaattgcaccactgcacttcagcctaggcaacagagtgagactccatctcaaaaataaaataaaataaaataaattaaaaaaataataacataatgaattttttcatgtctttatatattaaatatttacattatttaaattgttcaaaagcatcaaagattcctctctatcaacttcatttcatttattttattgtaccaaactatcaagaccattaatttaatctacagctaaatctattattttttcatgttagaaattccacaagaaaatttttccctaatgaaacctcacatttcaagcatcctaagtaggctgggcgaggtggctcacacctgtaatcccagtactttgggatgctgacaggtgcataacttgaggtcaggagtttgagaccagcctgggaaaaatggtgaaaccctgtctctactaaagctataaaaattagctgggcatggtggcatgcgcctgtaatcccagctactctagaggctgaggcagggaaatagcttcaacctgggaggcggagcttgcagtgagctaagatcgcactactgcactctagcctgggctacagagcaagactctgcctcaaaaataaataaataaataatcataagtagtaaaaaagtaaaatgaaataaaaaataaggcacagtgtcttgctctgttatccaggctagagtgcagcagggcaatcatagcagaccaacttggaacttctgggctcaggcaatcctcctggttcagcttgccttgcatttttttagagatggggtcttgccctgttgcccaggctggtctccaactgctggcctaaagcaatccttctgcctcagcctgttgagttgctgggagtacaggtgcaagacatgcagcctagcattgtagtaaaacaattttcaacaaattcttaattttctttctttttcttttctttttttttttttttttttttttttttttgagttgggcgtcttactctttcacccaggctgcagggcagtggtgcaataatagttcactgcagcctgcctcagtctccctagtagctgagattacagtcatgcattatcatgcccagccaactttaaaaaaattagctaatacttaaaaatttgtagagacaggggtttcactatgttgcccaggctggtcttcaactcctaacctcaattgattctccctcctcagcctcctaaagtgctgggattgcagccatgagccaccatacctggtttaattttcttattttaatcttatgtaagtgattattattgttcctaagataattggggcagtgactcctttaaaattttagagacctaatttatctattcacttcactgaaagagtatgccaatttgtttcatgagaaaataccctacattcataaagcaggaaaattccttccaccaaactagggggcattctaaagaaacaaattttgctaagtaacatcacttaaggtgaaaacagagacaatggtatctattaacaatgtttatcagtgaaggaaataaactgaaaatattaacatcattagatccttggagggccttcattgctgaaaaatctgagtaatattgtgatacccttttgagtccggcaggacattctctttccagggcatataacaatgggtgaataatttcttttcattcattttcattaagggctgaacttccttaatgttctggagattattaaatttgatttgtatagttgtgaaaagtgctcatattgctgattccattgcttatatgtgatcatataaatcttttctctcctttctgtagtgtggtttaaacttaatccttaaaggacgtgtatttgaatttttcagctggttagaaacctgaatataccaatcaaagaaaactgctccttacatgctacagatttagttttcttcttgtactaagatgtcttttagatatagtaaatttgttaaagccaagagctcctatggaatgaagttgaatgggaggggggatgtggagtagtaagatcacccttgtaacagagatgccactcttgcagattttgacaactattgggcccataaaacttttaccaaatattggaaagacaagatatgaacagcttattattgctgcagtctcaaatatcaagaaataccattattctcaggacaataaataggcaataaaaaagactcacagaccagattagctgtccaaacagggagtggatccttatcaacacaacccaacagagattgtccccagaaattcacttcataacatcaaaaccaaaaactcacactgatggcaaaaaataatgatgcaataatgagagagagacagagagagagagagagagagacctgtcctatagccatacttagtgggtaaaagccaaagagctcaatttctgctcatgatacttaatagaacagagggaacatgagccaatagctcagtgggttcagatacgcaccaagtgcctgttggatacaggattctactgtctccaataatatgtctcagatggactagtttttttgttttttgtctgttttgtttttgttttttattttttgtttttgagagagagtctccctctgtcgcccaggctggggtgcaacggcacgatctcggctcacggcaacctccgcctcccgggttcaagcgattctcctgcctcagcctcccaagtagttgggactacagacgcacaccaccacgtctggctattttttttgttttgttttgttttgttttgtatttttaacagagacagagtttcgccatgttcgtcaggctggtctcgaactcctgacctcagttgatcagaagtaggtgaggtcagaaaacataccctgggagaggctggcacaatgcccagatccgccatcgctaggcctggggttttcttctgtagtattcatgtagtgcagggacaaaaccaattagatacttctgggagttaaaaagagattaatttgccgggcgcggtgtctcacgcctgtaaccccagcactttgggagggttcacgaggtcaggagatcgagaccatcctggctaacgcggtgaaaccccgtctctactaaaaatacaaaaaattagccgggcgtggtggccggcgcctgtagtcccagctactggtaggaggctgaggcaggagaatggcgtgaacccgggagactgagcttgcagagagtcgagatcgtgccactgcactccagcctgagcgacagagcgagactccgtcaaaaaaaaaaaaaaaaaaaaaaaagatgaatttacagtgtcatttgagaaggggtattaaggaatttgccagggtactgacgcgtgtcagttgcaaactgcaggttgagagagagctaagtattttctgtccatgaaggtgataagcgagggcctgaagaaagaggaaggggggaggacactggcgccagaaataggaaagggctgcttgggggtgggaaggatgggtcggggtgctatctagaaagctgcctggcaatggctgtgggatgcggaagcgagacatcaaacaagaagctgtcgcttaaataaagtctgaagaaagactagatatgtaaacggcaggagatagtagggaaactggacccgtctcctcataaaacttcccgccttatatttcagggaggatcgcagcgcatttcggccaagacaggtgagactgcggttttgacctgcgggcctcgatgaattgcgttaggacacctgggctccgggagagccgttccactccgcaaagtaagcgtgttatgtctacaacccaacggggacgcgctaagagccctaaaggccctgctttcatcccaaagaacagcccccgcctgcgtagtttgtagccggctctatgaggtgagaacacattccccgctagcacagaaatcctacagactcctgagggggctgcagctagaagcagaggctgtgtgaaatgtgactgggggctagggaaaaacacgtagattttcacagaccctgagaacccaagagactgcagaccatgggcagacaaatctctgcaaaaagcagccccgcctagataaaggaagagctgtgcggccttcgcgctagctagcttgtgtaaaggtcgacgattcttatttctcccggggcggggagaaagcgacatattactactatttctcagccttcgactgtgagagtaacgattaagactaaaacacaagccagtaaaaaaaacaagtaacccttgctgtgtagactattctttaaactacaaaaaatcaggggaaagcgcgaacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgagctcttgcacctccgccccgccacagcctcacacgcttcaccctttacacacacggtcacttgccccgcgcagccccccccccccccccccccccagccctcctagccctgacacacagctgggactctcaggtccgaccagcggtcctgaacccgctcccacggcacgggaaatccttcgtggcgcagcagcaggtggggaagcagcagcccctgcgctgcctcatctacatagaagtcgccctatccgtgatgtcaccgacagtgcctttcccagtccccgtctgcctttctgccgctcagcctaccaacccgctgccggagccggcagggggaagtgatgtctgtctctcccttttttccctcccgccccggcatctgttctcgcccgaagaagctggtccttagcctgcgctgcggagcaacctttcagtggccacctggagcctgggcaccgttcttcaaataatggcttttaattctcagacgagaacgtttaggattacaaaagaaaccggttctcttcacatccttatccttgtcatgtagcattccgcttgaaattggaagccgttcaatgtcagagagaaaccatatttatgaaatgaaagaggcttctcagatgactgcaaaccagccttccttactggttttatcactggtaatgttataaagacagttgtccagtttcatgaatcttgtaggtttttgtttgtttatttgtttgcttttgatgttgttgttgttgctgttgttttccaaattcagtattgtagaaaaatatgctgccccagaagagatgattggacactctccagcgtggtgttggactttgtcatctcttgcacagccatctccagaccttagtgtttacctcacgttagttttttatattctgcaaagacaaaaccaaaataatccaaatttgacacaaatacctgggatacatcttatttgagatgtttaacaaatgtctggatcatcttttcttacattggattataacgcaggaaacactgtgaagtaagtaaagttggaattcccaagtcaaagaccatttgaatatttacaagtagatttgaggcaggaataatacagggtggccgcagggtaacaaattctaggcagcagatttacatgacttgaggctatgggctgataagacgctgaaaaaccagggtgtggaccaagctggctaagactgactggacccaatgtggtgctggatttgatgtaggttttaccgaggccctcattatatgctcattaacatactaaatcacacacccaccagtgccatgacagttctgagaccaatatgtgatgtaaaaatggatggcaccacagttccgagaaatctccacctttacccaggaattttcatgactattccactccttggttagagaaaccaatcaagatgaaaccccagaacccattgttctctctcgggtatgcccgaactcccctttcttgagtgtgtactttttgctttgcaataagtctcttctttcactgtttgctgactcatccttgactttgttcttgagatggtgtcaagagcctggacaccacagctggggtcgagatcccgctagtgtccggggactttccccaggccaccagtatcagattctattccattgctcaaatcacaaaacatcgagtggagagttctccttggagaccataaagtaaagattctgtggcatggtggccagttaggccactggaaggcatggcaaaatattgaaaatgagagattaggtgacagtgtagtaataactgctgaatactaaatatttgagccaggccccattccctggatactgacagggagacacattgtccaggtagtagtggagaaatactttctgggtatctgaccagcctttgtggaaagaactggcaccatcctgcagatgtaaccgcctgatgggttcttcctgcccactgtacatacaaaatcaattcatggagaccatggcattgaggtaaagagtttaattgacacaggccagccacgacatgtgggggacagagttattactcaaatagatctcactgaagacttggaggtaaagggttttcaaagacagtttggtggggagggggctagggtttgggcggtgctgattgttggggatgaaatcacaggggtgtggaaaatggccctcctgcattgagtcagcttctgggtgggagctaagggactggttgatttttgggccaaatggtgccatccagtagtcagaaatgcaaaagcctgaaaagacatctcaagaggccaatcttaggttctacaatagtgatgttcttcacagcagtaattggggaagctgcaaatattgtgacctctggaataatggctggtaattatttaacgaggcatacatcttagtagaattcaggcccctttcatcctcctaacttggtggcctttcattagttttatggggtaatttagttttggggaaggttatcattttaaccaacatttttggctgtccccaacctttttggcacctgggactggtttcacggaagacaatttttccatggaagggggtggtggatggtttctggatgaaactgttccacctcaggtcatcaggcattagttacagtctcataaggagtgcgcaatctggatccctcacatgtgcagttcccaatagggtccgagctcctatgagaatctaatgccgatgctgatctgacaagaggcggagctcaggtggtaatgctccaaagcctgcagctcacctcctgctgttcagctgggttcctaacaggccatggaccagtacctgtcttgtggccctgggggttggggacccctgatttaaactataaactcaatttttcccaaagatagcttgggagaaattgcacaggaacgagcaaagacagctagcctgtgaggctagaaccaagatggagtcagccatgtcagatttctctgattgtcataattttgcaaaggtagtttctgagggactaccctgacacttgttaaaagcatgaggtggattttattgtatgtactacagtaggcaagagagaccagcagagaaccgagctcaacctcaaatacagcaggaagagttgaagattatagccaattggcaagataagaaagtcagtggatggaaaattactaagaggaacttgattagctatcaaaggtggttgggaggactcttgctaaactagactcaacagtattcttttctaaaactggacttagcaggccaagaactaatagagaaaagggctcagaggaaactactaaggtttggtcaaagatggagtccttgtcaactctaaattgaagcttctgcaaataaacgaagaccaaccaaatgaaaaaaagcaaaagctatttattctgagcttgctatggcagggagtcagccactgttacttgtgttttggcagagacttgaaggcagtcagaagggtgagaaagctttttaaaaagaaaggcttcaggtatgcttggactggaggctgtcagtatggtgacgctgtagatagatgaagaaaataaaaatattttaccccagaatatatttctttggtatattttaagatggctgtcagagagccagcaaacagaagtaactctgcaaaactgtcttttgtaggggaaatttacacctgcagagaatctgcattaatccagccttcccttgtcaggattgagaaataaaaataagccctaggccctacaaccaactgaacagactccctcttggctgacaggaccacagagaaaccttgaaagctgtttctggctgtgacaggataggaggtcggacgtgcccccttaaaacccctccctcactaactgccattatgaggcaggagaatagcagagggaattggaagttggataaaaggcagaatgagtaaaggcagaaacagaagcaaggtgatggggcgggagagcaagaagcaaaataaaaggcagaagttgagcaacctaaacaaaaagtaagattaaaaaaagcaaggaagaccgggcacggtggctcacgcctgtaatcccagcattttgggaggccaaggcgggcagatcgcctgaggtcaggagtttgagatcagcctggccaacatggcgaaaccccatctctactaaaaatacaaaacattagctgggcatggtggtgcactcctgtactccaggctacttaggaggctgagacaggagcattgcttgaacccaggaggcagaggttgcagtgagctgagattgcaccactacactccagactgggcaacagagagagactctgtctcaaaaaaaaaaaatagcaagcaaggaccccattgctggcaagatccaaaccagtaaaggggcagctcctcagagacagacatgtgcattcaagaaaaaaagcatccttaacatgactccatatgataatcagctcattaaaactcatgcatatggactacatatcttgcatgtacttaaaattatggggtggagacaatgtgcaagcacacgagggccaaagtaactaagcaacccacccatcaatctaaaggcaaacactggctaaagattaggcatccttgggaagagaagaaaaaaaaacacacataaaaagacccaaagtacaccaaactaatactgatctcatctgccacaggtcagcccactctccccactccaagaatgttactgtgcttaataaacttttgctttgctttgctgctttgtgtgtgtcatgtacattcttcgtttgggacaccaagagcctggaactgcatggcaccatctggtaagaattaggatttttttttcctaagggttaacaaaccaactctttggaaagatttgcttcactactattatcaatcaacagcctgatactttccctcccttttgtggttttgacaaagcaagcaagcagcattccctcctgataagagaccaccgacctaggaatgattctggccagactacagaggatgtacagtgagagttttcatgtcttctgcttcagcttttgatgtcagagggccacaaactccactctcagatgattgctaatgccaccattttatgaacatgggccccatggagaggcacaaagctcaactgcacttctgcacatttttcctcttataaatattcatattggaatattatttggtactgcttccatgaaagacacatttgcagaatgtactcaaattagaagcattatataaacactataatgtagcagtggtgcatccagttctctcttttttttttttttttttttttgagacagagttttgctcttgttggcatgatttcagttcaccgcaacctctgcctccgggttcaactgattctcctgcctcagcctcccgagtagctgggattacaggcatgtgccaccacacccggctaattttgtatttttagtaaggatggggcttctccatgttggtcaggctggccttgaactcctgacctcaggtgatccgcccacctcggcctcccaaagtgctggaattataggcatgagccaccatgcccagcccccagttgtctatactatacaaatatctgcagtgtagacatttccacaatgaccaaagatatgtgtacaagaatggtgactgcagcattctttgtaatcctaaaaccaaaacaacttcatcccaaaaacattttttcttttttttttttttttgagatggagtcacactctgttgctcaggctggagtgtagtgatctcagctcactgcagcctccaccttccaagttcaaatgattctcctgcctcagcctcccaagtagctgggattacaggtgcatgccaccacgcctggctaaaacattttgaaaagggttaaataaatcatgcacaaactgaggaaaaatactgttttcaaaaatggtggagaggatcactatgatgatgaatgattccactggtcacattattaatagaacaatcagtaaatccaggcacatcctggagatagtactgaactcctattactaaaatatgaaaaaatggaggcacgtacattactcgtttaagcgcataagggactgaattagaatttatcacaccaaaagtgggttcctaggtatctgtttcaggatcctgagttacacaggtgtaaacccgccatttcaggagatacccggttaagaatcggatgggggaggggggctggcccttgacatggatcagtcataaattaggggtttggggctggcccttaacatggatcagtcataaattagtggcttggtactccgggaagataaaatcttccccatttgtctagtgattgacaatgcgtgaatgctttaaaagttgcaatcagcgtccctggatgggctcgaaccaccaacctttcggttaacagccgaacgcgctaacccattgcgccacagagacaagcactaccagttctaataggcaatataggaagggcacactcactaaacttcctccgtcccttctattctcagcgcccgcctggcaggacgactgagcaaggctttggaaaaccagagagattagagcggtgagttgcgctggtcacattggatacctgcgcgttaggagattctggagccagacggagagccgaatggccttcgcccgccctgcccctctcttgcttcagaagcccccagaaactccgcggtcggcgacccagcccgagccgcctgaggtcccaaggggaagctgaacgcctggtgggctcccgggatggttcttcccgttctttgtgccgccttcacccagtgaaggagcctgtatccaccctgctcagtcgcttttgggctgctgcggagcttccgctgccatcttcggatcctgtgttccccaccggggctccaccagggcagggatggtggtgagggtcgctcctgggtcccctcgcggggagcagggtctggcactcactaaggcgcacgactaggacttgtcgaatgaatccatcgtctcctttagcttttaatcctttaaagagcactgagagtggaaatcaagagattttttccatggggaagttctttttacaaagcattgatttctcggcaccccgcggggcgtgcaactggcagggcctctggtgggctttctgccgggtggagctgcgggggctcagctgggcgggggtcggttcctggggccgtagggtgggagcgggggaagggaaaagcaaaagctgggaaagaagccagggagacatgaaccagacatccagacctcctgaaaggctcgtgcagacgcacaggcgggatcttctggaagtgagaattgtttttgtttatctattgtagcagaatggggaaatggagagagaacctgaaagagccccaaactcgaggacctattgctccccaagaataacatcttccagaactagacagaaactaagcgtctggaaaccctgaaatccttggaggagtagcatcatcctgaccctctgtgctccttttggcaaaggacttgcttccattgtttgtttgttcaattgtctgtttgttaaataaataaaactcttttcatatatctttaaaagtacgttggttctattattttatgattacaaacaatgctgcagtcatcattcttctacacttgtcattggccactggtatatttccatagggtggaggcctggagagcagttgttccagcatagtgcttacatagattttatttcattccgttttctttcctttgttgctttattagctataacccttttcttatttcagtggctgctttagggtttctgggatatgtctttaatttatcacagtctgctttcaggtgtcattatgtctccctttctggcctttatcctagtgttatgtaattttactttatacattataatccttgtgattcattattattacttttatttattacaccaaatattttttaaaagatttaaattctaagaaaatgtgtagtacatgctttctaaatgccatttccagtattcgtttctttgtataggcccacatttttatctggtatccttttgcctctgcctggaggacttttaataagatttcttgtaacgtgggttggtgaattgttttagcttttgtatgtttttcgatgtccttatttcactcacagttttgaaattttatttttgcatagaattccaggttaactttttttctctgggtactttaaaaatgttaccatttatgaagcattgccattataatatcatctttctttcctgtgtttgtaagaatggcataaagccggtttcttgcggtggttatataattttcagaatgtgtacttaaatttaaaatattaaattttactaaaatactaaaaatattaatcatgaacatcctagattcatcttaaattccaccaacagtgcacttaaaatgtgcccaacctgagggtcaaacctacctgctgacgtgtaatttgtgtttgtgagacattctcaacagcatttgctttccctagctgagtgattttcctcacatctgaatgtcttcagtacaaaaggaaacctttgtctttgcaaaaatactttcaaatattcttacttcaagtaagtgcattaaaaacaaacttctcagttgcatccctggaatccgtggaaagcccgggagagacagtcaagtggttcaggatcaagagctaaacaagggaagacaaagcgtggcttcttcactaggagtccagccaaagtcaactgatttggtctccagtggaggtcggaactcggttcaccagcgacgtgaggacccggcccagaggaggcggactttctcttcctggtgccttcagataggaaatctagaatttctttctttccctttgatctacttctaactctcccgttctatttcttcaagacctttttcggatccctactgcgaaggacctaaggggccgatgcccttccctaacggtccctccctggctgagtgtcttcggagcccaagctcacctgtaaggttactgccctccggagacagcgagaggaccaaggagggcggcgggtgcggtgggaaccacagagtcaccgcgcacctgcgcctcgcgggctcctagcaaattgaataaatgatccctgaagcttctctgcaggtcacagggaaggggagggtaggggtcgacccgcggaagaagcttcaagaagcatcgggaggacctggccctgcctctgggccttgaaaacaggcctggccaggctgattttgtcgcgtaggcccaaagaaaagtgtcaagggcggcccaaaccctgacctcgagattaaggctcttaaatgtctgacggttttgagactcgtctgtagaatcgatcccgcctgtatccggagaccggagactcctttgccaaaattcagagaccaagaaagagaaagattgggcagatcaaagtctgtaattaacccaaacaggaaacgtaatttttctgacaaattgtatgtgtgctctgagaaaaagactagcctcaaggagaatctgtttttttggcttgagtgtagggaagaatggaattgccaccaacaatgttgcgttgaaacggcaggtgcatcaggctgtagatgtgaaggaattaaaaatatttcaccccaaaatacatttctttgacacattttgagatgtctgttcagaaagccagctgcagaagtagccctgcaaagttgtattttgttggggagatttgcatctgtagggaatctgcattgatgcagccaagtctttctttgcccagatctaggaaagattaactgagagtctgacagctgtaaaggtctcaaagaaacttttagggtttactgtctctgagagctgctacctgtaaggtttcatttacatattaagaccacctttgctagctaagcctcctcttctctccctcctataacctgtcttgcccacaataaatggatatacatctgactctgatggtacctggttttggccatgctttgagccctcattcattctgttacctcgagatggtgtataagcttctgcatcccattgtgggtagggtagggtaatcactctgtggccctccccatgtacatgttagtacattttatgccttttctccaattaatctgccttttgtgagttgatttttgagtgaaacttcagagggttaagagggagggtttccattggcccctacagttttggagctgtaagcaggatagtaaagctctgctcttctggaagctgcagtgaagaacccaggatctgatcagctgtcataagggtaagaattttttaccagccaggctcccagcctccttctctgtgtggaatctgatcaagtgcacagtaaaaatcactgcttcttttccctctccaaaatcttgattaatgggagaaaaggatttgtgtgactagtcttgggtgtagtgactctggtgtgcttttttggtactttgtggtaccaattcatattgtttaatccctttcttcccagaaaatgtctgttcctttgtctttgtctctacgtgttattctgtcataaaagggggtactggttgaggttccttcttatcttattttatgtccttgagagcttgacttgtgacaaagtgggagcactttctcttggtttccgctatcgggtaagaggtggtaattttcaggtcatattaggtggcctgtctgaaaatggctggaaacccgagtacactttttgttctaactatgtcaagctcttggggtttgtcttaagaagtcccatcccttcgaggcttttgccgtctcaactcttgttgcctgattagtcctagaaaagctcagtcccaagagggcctacctggtatcacagattcacaggtctgtgactggaagcctccacaaatttgtgggttactggaggcaatcatcatccttaactatctgtggcctactccttacattgaacttttttcttggaggggagtctttgggattgcctcttctatgcccttcccaggaagttaacctggaaaatgacatcctgggctttccacaaagaggctatttggttgaattgctattggaataattataccattggatattctagttgccaatggcctgaagatggatcccttaaattagacacctgaattaaaaaaaaaaaattagagatctcttatttgaaacagttgataggaagatcaaattaaaagaaagacacatactagtgtgatagctacccttaaaaattctcttgacaatattatctgtcttgtatagggaaaaaattctcttgactaaattaaagagcaaaatttgatccaaaacaaagttaaaattcttcataagctcaaactgcctgctctggatcccttccaggattcacaataaagtctgctctaccttgcagtttagtacttaaagttctgtgcttttgctgccatagcctgggttcaatttccagtcagggaaccagtttattttggcttgatatttgtgtgacttttgactttttggaatacccatttattgatccttttcccgttcatgggcagctttttttgttctttttgtttgtttgtttattaagacagattctcactctattacccaggctggagtgcagtggtgcaatctcggctcactgcaaactccgcctcccaggttcaagtgattctcccacctcagtctctcaagtagctgggattacagccacccaccaccatgcctggctaagttttgtattgtattattagtagagacagggttttgccatgttggccaggctggtcttgagctcctgacctcaagtgatctgcccgccttggcctcccaaagtcttgggattatagatgtgagccaccactcctggccattggcagcttttgatttcctgtcctcccaacttccaaagtttatgaagagaaatctgttgataatcttattaaagatttcttacgtgtgatcagttgcttttctcttaccgatttaaagattctctgtttttgacttttgaaagtttgattataatgtgttttggtgtcggtctctttaagtttatcttacttggagtttgcctggctactgtgtttgtattcaggtctttcatcaaatttgggaagttttcagccattatttcttcaaatattctctcttgcccctctctccttcttctttataaattccacaatgcaaggctgggtatagtggctcatgcctggaatctcagcattttgggaggtcgaggtgggaggatcacctgaggtcaggagtttgagaccagcctgaccaacatggagaaaccccgtctctgctaaaaatacaaaattacccaggcatggtggtgcatgcctgcaatcccagctactctggaggctgaggtgggagaatcgcttgaacccaagaagcagagtttgcggtgagccgagatcacgccattgcattccagtctgggcagcaagagcgaaactccatccccccaccccccacccccaaaacaacaacaacaaaaaaggaattccacaatgaatatgttggtccacttgatggtcacttaggctctgttcacttttcttcaatttttttttatttctgttcctcaaactggatgatttccattgtcttatcttcaggttcactgattgtttcttctgcctgctcagctttcttcaaatttgactttgaatccctctagttaattttttatttcacctattttacttttcagatccagcacttttttgtttcttttttgattttctatcctttatttatattttcattttgttcatgcattattttcttgtcttgtgctacatcttcctttagtttttgggtacctttaagacacctgtttcaaagtctgtcaagtagcacatccagcaggttgtttttttctctctctctttaattatttattatttttcttttcattttcttcccccatgaccaaatcttaacttgactatcaggcatttttcagtgagagtttctgttggttcatttttttttatttatttttattgttgttgttgaaaactggacatttgaatctactagtgtggttaattccagaaattagattctcctccttcctcagggtttgctgtttttctgttattgttttgttttttgattattgtaggttgtctctatgccaaggatcagcctgaggtataaacttatggtcttcacagatgttttctgagcctgaacctttccctgggtgtgtggtcactccctaattttacctatatatgcagttattcttgaatattttatcctttaatgtctggctcccaaaaggggaaaaagagaaaaattgagggagggtgaaaaaagggcaccatccctttaaactttctggaagttgcttcagcttagggtgaggagcttgctacaatgggggaaggtacagcagtagctgccagcctctttgtctctgtgctgcaatcagacattagagaacagagccccaatgtgtgtgtgtgtgtgtgtgtgtgtgtgtgtgtgtgtgtgtgtgtgtgtgttttgagatggagtctttctctgtcacccaggctagagtgcagtggcatgatctcagctcactgcagcctccgcctcctgggtcaagtgattcttgtgccccagcctcctgagtggctgggattataggtgcctgccaccacacctgactaattttagtagagacagagttttaccatgtgggcctggctggtcttgaactcctgacctcaagtaatccacccacctcggtctcccaaagtgctaggattacaggcatgagctactgcacctggcccagacccccagtgtttggagacagcattctttttgcccattctggatcctgaaagatgtgtgcagcttactgtaggaacacaagctgactgccttgggggtagtgttgggtagctgctattgtgctaagggccgaaattgactgaaattacctacaatttaccatctgggccttcctctggaagttgcaagccttcagtaggctccagagttctgaaatatttacatctgacagatcctgcccatgcagttgttgtgtagattccaggtgcttctcattccaccatcttcccaggataccctctgaccttctggattttgaattcagtcaagctgttctctaacagctggggtgaaagccaacaaagatcctgctaagaaagctccctggaaaaaaaatgttcaaaagtaacacaaatatcaaactggaaagaaattgatttaggaaccgaacccaggttgtcatggtgaaaaaaggagcagaaccttagctaccgaactgcagcctggggtatgaggtgacaaccatcacttttttagtttggtttggctagcaaaggtggccttgttatacaaataaagccactcaggtagtcaaaacctttattttctgttttttttctctctctttttttttctttttgagaaggagtcttgctctgtcacccaggctggaatgcactggcgcaatcacggctcactgcaagctctgcctcccaggttcatgccattctcctgcctcagcctcccaagtagctgggactacaggcacccgccaccacgcctggctaattttttgtattttcagtagagacgacgtttcaccgtgttagccaggatggtctcgatctcctgacctcatgatccacctgcctcggcctcccaaagtgttgggattacaggcatgagccaccgtgcctggccctatgcctggctaatttttaaaaattttttgtagaagcagggtttcgccgtgctccccaggttggtctcaaactcctgagctcaagtgctccaaccaccttggtctcccaaagtggtgggattacaggtgtcaaccactgcacctagcctctaaatccatataaatcaattattcacgcactgagcagaatattcaggattttttttcttataatataaatgatgtggaaaactggagaaccaaagaagaacaccaagactatctaaaagtgttaaatttttcattagaaagaaaatgacttcatgacagttcttaagacaatgatagaacttggggaaatatgtattccttgatgtttctatgcatttgcaataataaacaatgaaaatatggttaaattttagaaagagataggcctgtggtattgtcacaagggtatacaaatactgagaatgactgctgaggcagtgctctccattggtggtgaccttcagaagagacctgtgtttccacatggcctagacacctggaaggcagagatcctaacattccatgacacccccaccttctaattctgttattgtgactccagaccattacctggcaccgggtctgatttctggcattcctatcagagcctgagtcacagacagtaccttagactctaagcttaggcaccttgtgccttgtttttgtggctaaggattctcagagttgtaggatgctgacaaagtttatcccaaaggtaatttatgaatcagatctgctttcttttgacttgtttaaacccttcatttaatgtaaagaaactttattgaggtataatttacatactataaaatttacccattataattgtacagttcaataatttttagtaatttacccaagtagtgcaaccattaccacaatccatgcatttgtttttaatttattaattgtctgggtttattctccctaggctctgattgtactttctccacaagcttcagcatggcagtatctctcaccacttgttttggtccaagggcagaaatgagcatcctggaaaccaatcagtacttgctctctgaactggaaaagtgcaaagagaacttccgagacctcacagagaaattcctgacatccaaagctactgcctactccctggccaatcacctgcagaaatatagtaggtcccataggggcatggtcaccaaagtgataaatgattgtctgtctttcctctgtgaaatgaaacactgcagactttattctttatcaaaattaattttatcctaactacactcccagaaaggtagaagtgggccttttactctcaatttgccaaggacagaaaaactgaggcacaaaggtgtaaagtttgcagggcgagtgtagtgaggaatagagactaaaaccttggtttaggcatgaaactgtctttcccctctcagcaatgaatatcagattctacaaacatgtaacatcactgttggttaaaacatctcaggatttgatttaaacttttttaagagcgcccatttgcaaagcactgtgccaacagcaccagggatgaaagaagtaatagtataccctatctgccttgaaggaacttaaaactacctattctcaactgagtcacagatatgtggagatgcaaacttcaatagcagacacggagaaaaatctttatgatacctggatcaagattctcttcccacataagttcacataagccattcctcatgttctggttagattgagggtatttccataaaaatcagtgactttgttacaccctttctgtctctctctgagtatcaactttacagacagcaagcaactgcaggtggatgtccaggataagagctatgagacatatggccaaaatgagaacaaggccaagtggaagagaccgccattctcagtagacggccaggccaggttaggggctggccctttcctctccacagttagctctcacatttttaaatccaatgtaaaatcccaaacctgttactaatagtcggagaagggggaagctataatgacaaggaaacatgggaacaagggcatgagaggaacagggatattagaagaggattctggttaacattgaaattgagtttgctttccaatttctacaattgtttttaaataaatcatcgtgtggggggtggttaaatttgctgtctaacttactgtcatagaaaagtaaagccaaaagcccacttattaaagaagtgaaaagatgagctttggtttgttgaaaaactagttaaaaaaaaaaaaaacttcattcattataattgtaggaaaaatatttctcaagctagagaagaagaaagatattacctaagaccttagtataaaggtattattgtgcagtgattaaagagcatataccctagggccaaatctcctgggttcaaatctaacttattgtctctgtgcctcagttttctcatctgtaatggtaacagagtaggaactacctctttggatagtggtaatgatcatatgatcataattcttaaaaacctactgcaacagtaccatgacaaacactatgtgttggttctccctttaaaacactattagcatttgggcatatatcatttggatctttctcctccatatacagttttacacagttgtatacagataaatgtttaaatctttgaaatattttcgaattattgaaactcttgaaacaggagaaccatcagttctacagttcttagtatcttcctaaatacacaggaagtcattatttcatgcccttatgttcatgttttacttaagaggctgtaaagcttggtgaattggccttaagatttgaagtcatggccgggtgcagtggctcacttactgtaatcccagcactttgggaagccaaggtgggcggatcatttgagatcaggagttcgagagcagcctggccaacatggtgaagccctgtctctactgaaaatacaaaaactagcagggtgtggtggggcacacttgtaatctcagctacttggaaggctgaggcaggagaataacccgggagtcagaggttgcagtgagctgagatcgtgccactgcattccagcctggggaacaaagtgagattccatctcaaaaaaaagaaaagaaaagaaaagaaaaagatgtggagtcagaccccatgggacgtgaattctgactgcttcattccagttgaatcatcttgtcaagttactttatcggcctgtgggcttttctttcctcatctctaaaacagggagtagttgagagactgaggaataaagatatggaaatcccagtgtaaagcctggtaccggggatacttttatccttgagatagaccctgcctcctgccctgcaggcagtgaccacagcagcatggccagccttccatgatgcaggcatgtctgtcttctctcagagtgtgaagagtgcaaagaccttatagaatctgtgctggaggaggagctgcagtttcaggagagggagctgaccaaattgccaaggccagcagcaaggctccggtaaggaggtacctctgtgggaagtgtataaatactgtttgaggtggggcagctcaggcaggtagaacaaagagcaaatttgtgcaaggagaagggcagaaatgtatgaggcaggtacagaactagactaagacacaatgaggctatagtctagttaggtctctagggttttccattaaagaacatattagtaaaatggagacagctgcctgcattggaatactagcaacgtggcttctatttgtgtatccttggtcaaatttactgcacttttctgcatgtcattaacctaggctacctcatttataaaacggaaatactgacagtatctaccttagagggttatgaagattaaatgcacaattgcaagtagttaaaaccatctctaacacatataaaactctgaacaactattttctgtaattattttatttgttcccatttatagatgtggtgattgtcattaacatttcctataagagatattttcaaactttccaaagtgcctttcatgataagaaagtttctcctccaaacttttttaaaaagtattatactaggtgaagtattaactggtagggctattgggtagatagatgattgagcagctgttgtgtggaaaatgaattattaattcactcaggaccagcattgactatccttagagggtttcagacataaggtagattgtagcatttgaaacttcttttaatcctttgttgaaatgaaatcatagaagctcaaatgtgtaaaactcaccaaagcagagatatttgattgaaggagggataggtctggagcccctgtttctcgccagtatgtgtctttacttcccctgacactgtctagtaactctgtcgaatagagtttgaaagaggacctgcagataacaactttgaagaatagcagggagaaaattcaagcattagatggggtagatgactgtaaatgttcagtccagctctgggattacatggttctaaacattaactgaataactacttgtatgtgtacatactaccaggtgctgtgagttgggtaataggtggcactgtctttagactcacagagctcacactctacattggaacccatgtgtattagtccattctgacactgctataaacatgtacctgagtctgggtgatttataaagaaaagaggtttaatcggctcatggttctgtgggctgtacaggcttctgcttctgggcaggcctcaggaaacacaatcattgcagaagttgaaggggaagcaggcatggtcttcacatggccagaacaggagagagagagagaacaaagagggaggtgctacactttcaaacaaccagacctcatgagacctcactcactaccacgagaacaggaagggggaagtccacccccgtgatccagtcactttccagcaggtccctcccccaacattggagattacaatccaacatgaggtttaggtggggacacagagccaaaccatatcaccatgagaaatatttgaacaataattagaaagcaatgaaatcccacatagagtaatgaagttactactcagaacattacttcttttttttgagatggagtcttaccctgttgccgaggctagagtgcagtggtgtgatctcagctcactgcaacctccacctcctaggttcaagcgatcctcctaggtcagcctcccaaggagctgaaagtacaggtgcacaccaccacaccagctaattttagtatttttagcagagatggggtttcgccatgttggccaggctgctctcaaaactcctgacctaaggtgatccgcctgccttggcctcccaaagtgctgggattacaggcatgagccactgcacatggccggaactttagttttaactgccttcttactgattatggtctaccttcatgtcattcaaaagaatactgcccttcttgaccttttcactgatttttctttttaactttcaattaataccagagatacctgcccaacacttttgaatctggctttttttttttctgccagttactgcataatgcttgatgtatattgtatgaaaatgtacttgggctaaagtggggaaccaaaggggcatctttttaaagcaaaggtagtaaaataacagacaaacccaaggctggttcttcattccttctgccacaggcaagtcacacaacttgtacaagaattaatcttgggccagatgcagtggctcatgcctgtagtcccagcactttgggacaccgaggtgcacgagtcatttgaggtcaggggttcgagactagcatggccaacatggcaaaaccccatctctacaaaaaatatataaattatcctggcatggtggtgggcacctgtaatcccagctacttggaaggctgaggcaagagaattgcttgaacctgggaggcggaggcagaggcggaggctgcagtgagccgagatcttgtcactgcactccagcctgggcgacagagtaagattctgtctcaaaaaaaaaaaaaagaaaaaaaagaattcaacttgggagttccttacagggattctaagagatctctcctctgaaacttctataacctattattcactacattccctcttacattttactcttctttcccaccttaggatacatgatcccttaattcaggctcaggctgaagaactgacccacttacgacagaagatacaagaagggagaggtgtctgctaccttttcacccagcatgtgaagaacacagtcaagtcttttgagggccttctcaggaacactggcattgcctactaccagagacagagattctgtgagcaaatggtacaaggaagccagctaacagagatccttgtcagaaaacttgccacaggtaagttggctacaggctctgaagacccttacctcctcccaagtgccccaaagtggggagaaaaaatgcaaagttatctccattgtagattttattttagttttgactatggtccttaatctgcattctattgttttctctttagagcactcaggtaatcacttttcatattctttcaagagtcctgagttttgttttttattttgagacagagtctgctctctaacccgagctagagtgcagtgacgcgatcttggctgactgcagtctgtgcctcctgggctcaagcagtcatcccacctcagcctcccaagtagctgggactacaggtgtgtgccaccacacctggctaattttcatattttttgtagagacagggtttctccatgttgcccaggctggtcttgaactactgagctcaagtgacccatctgctgtggcctcccaaagttctgggattacagatatgagccactgtgcctggcctgagagttcttagtttcaatcagtaagagaggtagagtatagtggattacttcatcttgatgagcataagaactcaccttcatttctggaagatattttcactggatgtaggattctagttgacagtttgtgtttttaaaaagtgtttgaaaagtgatattccactgtcttctggcttacattgtttccaacaagaagtcttccataattcttatttttgtttctctgtacataatatgtctttttctctggccgcttttgagattttctgtttatcactggtttgaagcagtttgattaaggtaagaccatgtatagttttatcttttaagtattgttttactttatttagtttcttgcatctgcatgtttatagttctcatcaaatttgaatagtaatgacatatatagtcttatctatggcatatacagtatatttggcatatatatatcaaatatatataatgtatattctattctttctctctatcctctccttcaaagactccagttatatttgtattagctgctttgaaattttaccatagctgactaatggtctgttcatttttgttgtatcttttttttctctctttgtttctttctatttccatgtctcggaattgattaatctttctttagcagcatctaatctgctgttaatcctatccagtgtattttcatctcaaactttatttttctttttttttttattttccactttgtcattgtgtgttggttttttttttttttttttttattatactttaagttttagggtacatgtccacaatgtgcaggttagttacatatgtatatatgtgccatgctggtgtgctgcacccactaacacgtcatctagcattaggtatatctcccaatgttatccctcccccctccccccactccacaacagtccctagagtgtgatgttccccttcctgtgtccatgtgttctcattgttcaattcccacctatgagtgagaatatgcagtgtttggttttttgttcctgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatggcagcatgatttatagtcctttgggtatatacccagtaatgggatggctgggtcaaatggtatttctagttctagatccctgaggaatcgccacactgacttccacaatggttgaaatagttcacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcctttgctgtgcagaagctcttcagtttaattagatcccatttgtcaactttggcttttgctgccattgcttttggtgatttagacatgaagtccttgcccatgcctatgtcctgaatggtaatgcctaggttttcttctagggtttttatggttttaggtctaacgtttaagtctttaatccatcttgaattgatttttgtacaaggtgtaaggaagggatccagtttcagctttctacatatggctagccagttttcccagcaccatttgttaaatagggaatccttttcccattgcttgtttttctcagatttgtcaaagatcagatagttgtagatatgcggcattatttctgagggctctgttctgctccattgatctatatctctgttttggtaccagtaccaggctgttttggttactgtagccttgtagtatagtttgaagtcaggtagtgtgatgcctccatctttgttcttttggctgaggattgacttggtgatgcgggctcttttttggttccatatgaactttaaagtagttttttccaattctgtgaagaaagtcattggtagcttgatggggatggcattgaatctgtaaattaccttgagcagtatggccattttcacgatattgattcttcctacccatgagcatggaatgttcttctatttgtttgtatcctcttttatttccttgagcagtggtttgtagttctccttgaagaggtccttcacttcccttgtaagttggattcaaactttatttttcatctaaatttaatgtatgtctttctttaaggtcttctatgtaactcttcatcatttcgtattttgatctagcttctttattttattttattctattttttgagacagagtctcactctgttgcccaggctgaagtgcagtggtgagattttggctcactgaaaccttcacctcctgggttcaagtgattcctatgcctcctgtgcctcagcctcctgagtagctggggttacaggcacatgcctccacacccagctaattttcatatttttcagagagacggggtttcaccacattggccaggctgatctcaaactcctgacctcaggtgacccacccgccttggcctcgcaaagtgctgggattacaagcatgagccaccacaccagcctagcttctttaatacaaggaatatagttatgtttgtttcaatgtgcttgtctacagattctgtcatctgtgtcctttttattgttttttaattctcacctgatgtgtcctttctaagtcagtttaagtagattgattttttcccccttcttatcatggattatagttttctgtctgtctgcattcctaacattatttgatttggggttagacgttgcaaattgtaacttactgagttctggatttttttgaatttagtgttaaaattattttagctttgttttggtatacaataaagttacttaaaaacaattttcatcttttcaggatggcttttaaatttttttaggcaggataagagcagctattagtcaactgctatctttttcccactgtggaggcaaaatgacttttaagaaaatagaccttattttttagagtagtttcagattcacagcaaatgagcaggaagtacaaaaagttcccatataccccctgcctccacacatgcatagcctcctagattatcaacatctctctccagaatggcacatttgttacagttgatgaacttacaatgacatgtcattatcacacaaagtccatagtttacattgggagcaataatcttttgaagattctaagtcagtgatctcccacagatttggcaccagggactggttgcatgaaagacaatttttccacagacaaggtgggggtggggtggtagggattgggaattgggtggtttcagtacgaaactgttccacctcagatcatcaggcactagttaagagtctcataaggagcgtgcaacctagatccctggcatgtacagttcacaatagggtttgtgttccaatgctaatctaatgtcatcgctgatctgacagaaggctgagctcaggtggtaatgctttctcgctggctgctccccttctcctgtgcagccccattcctaacaggccatggaccagtgctgggggttggggactcctgttctaaccaatgctccctctattaaaagggattttcactctagctgatggaaacaccaagtgttgcaagctatgtgtgagctacagagattattccttttgggaagttctttgccctgctttgcataatttcctcaaatacatgtactaatcagtacttagctgaagattgaagacagatatccaaggcattctatctgtgcagcaacctattctctagtctgtcctgtgatgtctagccaccctgacttcttcaaacttactaccaggctctgcctgggtcctccctccctgctctacagttgacaatctcaggcagcaaactggagcaattatagggctcacctcttttatttattatagtactgcactatatccaatgttgaaggtagagtttaaaatactttttccagtttctcagttgtttaaggtggaggacaaatcaggtctccattactccaaattggccagaagcagaagtctccattccatctttgtggtcagaaagaacagtatgacagaaggcagcttgttagaatgggaagacccatgggctaagaatcagcattacctaggctctagtctcagcactgtatttactaactttgtgcaagtgattgatccttcttgaatttctgtttccccatttgtaaagtgggtcaaatcataattccatggctgctgtacagatcagttgaagtagtatcttaatgttcatgagtgtatttctctttcagggttatttatttttttatttttgggtcccaataaaccgtccaaatcttttggggttagttcaggcactgtatatagtagaagctggtgttagaaaagttgatttatactggaatatttttcacagaatcaaccccaatgctcactaacaaactgagaagaaaaaaaaagaattacccccaacaacatctgaggaagcagaacagggacagacttgaaggcacctgggcagtcctctggttttggagtagaggtaggacagggctatttgtcctctcagagactggagcaggttctgtgtgtgagtagcaatgggacaaacagtcgtggtctggcaaccagcctgtagcaggaaggaaggttacaactggagaagtccaaagggcaaccaggcaagtattctttgagctggggaacaaaaggcattttaaactttttgctctgcttcaggcagctgacgtctggtgatgattcaccatatcaggaacaccctgtccagtgggctcaggcaagcctgccaggccacttctctaaagacacaacctgaggcctcctgcaataattctcacagagcattctgaacatacatgtaaggtgttatgtccctgatcatatagggcccatgtgtgcaatgtgtgaaatgggacctgcttaaattctgactagctctttctaattttggcttgcagaaaatcacaatggtaagaaaatgaagacaggcaaaagccactggctcccaggtaactctacatgatgaaggggctgataatggactgaccaaatctagagagaattccagaagcaaggactcaagaggttaaaggtcccagatctagaaaaagcagaaactgctgattgttcctttttttgttgactgattatacaatgtgtccttttaaaaatggttctctgttctctttgcagttgttgtattggttcctagttcctagtaatttctcacacttagttaaccagtcagtcttaccgaaaagtaaactaaccagggatccctggtttctgtatctttaaaacctatagggttacaaaccaaagtgagatgcctatctggtttctgcacagttgtcctgaattatgttggcagatattttatagccagaaatttaccttgaaaaataaattgaaaccataccaagtatttagagctaggggtctaaaatctgcaaaagccctgggaggttgtgttgtctcaagagccagtattcagtggaccactccacatcatattaaataaaatttaaacagcattttgaagccgacagtatgggtcactgtgtgtcctgtgtgccgtgagcgtattgtagagtagttgttgagtctgctgccttatctgtgtgttatgaggtcaatgcactgatcacttgcttttttcacttctatactaactctaggcacactttactcccagtcaaaagtggactgtatacttcctctttgatgtgatggtccctttggttttggtgcctcttccatgagcttcagatcagaactagctatgtggttccaggctgccctggtttaatcccttgtcttgcctacttcacctggctcaagagggaagtccaggaggaagaaatggatgaagtcctggaggactcactagatgaacagtatttgactcattccagctgccatgactcccaccagcttcccagcagcaatgccttcctctttgatgcacaggaaggcccctcggctgtggaaatagccagtaagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaactctcaagtacaggtccctggtgggtcaggtaatttgctctgttcctgtcctcacctcagtccctctggtccagacgggcatctgcaagccggtatactcaaagcaggccagaatggagagagtgaagagattatggcagactctctgccactactgccacacatgtacaaatctgtttaacagatcttcttctttaaaatgggacatctcatctttcctgaaatatatatattttttgagacagggtctcttgttctgtcacccaggctagagtgcagtggcatgatcttggctcaccacaacctaaaacccagggtcaaatgaccctcccacctcagcctcctgagtagctgagaacacagatgcatgccactactcctggctatttttttttgcctttttggtagaggtgggttcttgcttttttgcccaggctggcctcaaactcctgaactcaagcaattcacccacccctgcctcccaaagtgctgggattacagatgtgagccactgcacccagccttcctgaaatattcttggtaattatagttcctgaacagttttcccaagctgttctagccatcccaagaatgttggcaggcttgtccatatgtttggaggtgcaattataatggttcctgggtttcaagctccagtctccatctcccctcaggtgcttgctttcccataaggttccatctgactactggaatatcaggggatttccataaagacaagactttgatcttggcaaccctttggtaaatagccagggttctcaatctttgtgcagcaccaaggtatttttaagatgtctgttagtttagtctcagtgttgtaattccatctaaataaacaatgaggctatctgctggagaaaaggctgaatctaagagcaatgctgccagcatgccctcttcccagaataactccacgctagccattggagcttcattaggtatataagagccctttggtttggtagcctctctggtgtgtgtatagattaaatccttgacctatatctcctctcccttacttgaatgtttgactttactttgggggcaaaagtttggattgttaggagactatatgctttatatactcttctatgcaataaaaagagattatattaattcactcattgagctttcacagtaatgtaaaccatattaggcttgtcattctgtcagtgatgggtgtaagtttgtggctttaattagtcataccatcttctgacaaaggcatccttatttctctttccaatttcacagtaaggtgtagaagaaggtctttaccatctgttaaagatgttcagggccgggcacggtggcgcacacctataatcccagccctttgggaggcctaggtgggtggatcacttgaggtcaggagttcaagaccagcccggccaacatgctgaaaccccgtctctactaaaaatgcaaaaattagctaagcatagtggtgcacgcctgtagtctcagccacttgggaggctgaggcatgagaatcctttgaacctgggagacggaggttgcactgagccaagatggtgcctctgcactccagcttgggtgacagaatgagactctgtcaaaaaacaacaacaaaaacaaaatatgatcaggagagatattttgtagagaggaagatattccctagtacctataagtcatctcaaggaggtggtcataccttttctagtgctagaaaaggcctactcagagaccttcagtgttttcccacctcctgtcaacctgccttatacttcccatatctccatgtgggaggcatccctgtggagtttgcttagcacttggccatgctttctttgaaaccttaaaagctcgtaaagaaagttgccttatgttccctgatgagaagatgaagttggcaaaagaatggtgaaaggcagggatcttgatgagaggcccctgactatccctttagtgatcagcatcttcacttcccatctcattccatgtcctggtggaatggctgcagaagatgagatccagagccagtggcagcacctgaaagagatccttttcatcaacaactgcctgtgagaaaagctagaacatcatcacagcagctttgacgaagaaaatggtaggagaggcccaagtcagcctgcttctggcaatatgtatttttctaaaggcatgtgactggggcagagttttatagatttcaagcactttgacatactttacttcacttattcattacaaatgtcccagctagagaggtagggcagctactatcattcctatttataggtaaataaataggcttaaagatttgccttcatcttagtggtatctacctctaaaatcattcttgtgattcctaggctgtcttctgtcttctgtctgctgctgtacactgcctgctgtctctctgcttcttatgtgattggcattcagtagaacccaggtttctcagcacctcacgtagcagaatgagagtctcctctgctgccatcctcatcagtttcccttatgtcttggtgactcttcattctaccaccccaaggtggttctctccaacccccctcctcttagattgttctcacacagaggccgtcatttcataacattgtgctgggccagaagaatcataagcaggtcccttcccataccaaagcagtaactattttggaaaagcctccttcatattgcagccattggacatgataatacatgtgatgtgctggcatttgttgagaatcatgtgaaaattaagcttccaccccatcacactaacgttccagccctccacggttttctccctaggctaagatagagaggaagaacatgaaatgtgcagaaagcattctcttaagcaaacgtgtataacttgcgtaaattgtaattatttcctggaacaggatgcacctctaacctctacaggcaaatcatagattccattgtccagctgtaaaatgaaaacagagttctcagagaagaataccggagactcccccgacttgcctgaatcaaatttccagaggtaagtggtgaaaggctacaatatgaagtcactctcagatgggtcccttctcttgccacactccactgtagaaataaaagaggacggggaggccagagctgctcaaaaccttataacccacaattctcatagtcattctcaacttagagagggctgctttctagacacaccccctccaggcccccagactgccaggctccaggaataagtagctctaagaaatacagtatttcgatgcgagccacaccccactattgcaaattggagaagagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcaccactgcattctagcctgagtgacagagcatgactccatctcaaaaaaaaaagaaaaaaagaaagacagaaaagatttaagagaacaattattttaattgaatacattttgtcaagattaaatcaactttcccctagaatactgaaagaataagcaatcataatttagattctaagttactggcctttgagaaagtgtgaaatccaaaaagatgccatgagccaaaaaagagcaaaagtcctaattttcaaactgatgaaaataaagtactaaataattgaaatcatcgtagttcatcttggtccttggcaaaataaaaatttattgattgaaattataatatcctagctacctttttgtgcctagctcttaccactgaggagaaaaaccaaacacaaacaaaagtatgttcaaattggcaaaaatgtttacaaacctgcaaaatctcttcagcctatcccttaaactgcagacttggtatttactaagctctgctgtgtacaatacccaccttaatatccattcttgcacaagttctgttaggtataagccaaaatcacatgggatttttttttttaccctctcatgcctatgtttgcttttgcttccaaagacccttctgagtaaggactgtcctcagactactggagtcacttagtcacaagcttgcctgaggctcagagctggcaatacctggcagtttatgtcaatcccacatgcaaccctgcctgcaaagtatttacccatgattgacaggtgcaggtgtatgaaagcccagctccttgacttgaggggtgcgtttgtggtgaattagctttgggaaaagggaatccagaggccaactttgtaaaaatccagataggtaaatggagagaaatctttgccttggaagtccaattgagaaagatagtgatttacttcggactgtgaaaggagagactaaaatctttactttctcatgggaaagaagcctatggtgaaagagaaacaaagaaaatggtgggaaatagggtaggtctactcagtagctttaaaccattctgtcatattataaagcctggtaaggttttaactaacacaagtgcctggactctacacatagatattctgatttaaatgcttccaggtgggtggaagacaccagtagtcttaaaaagctcccaagtaattttaacatgtagctaaagatgaaaaggacaatctatctactagaatgtcaagtcgtcagcataggagtgtcccaaatgtgcagctacctcatagaaaaggcttaaccccacccattgatggaattcgccttcctctctccatggtcttgtttgcatagcatggaaaaaaagagaagagaaaaagaggtagatggatagattgaacctataatttgccaatgtggagcagtttctcaaacttttctgaccacaagatgcagtgagaaatacacaattttttgtgatcagtttttaaaaaatcttttattatgtgtaatccacccttcctggtatttaaataaagcctgtagtagtaagcagtccactatattgatttcacaacccataagttgttcagaattgcaattagaaaatttttaattttggccaggcgtggtggctcgcacctgtaatcccagcaccttgggaggatcacctgaggtcgggagtttgagaccagccggaccaacatggaggaaccctgtctctactaaaaataaaaaaaaaaatttttttaaattagctgggcgtggtggtacctgcctgtaatcacagctacttgggaggctgaggcaggagaactgcttgaaccctgggggtggacattgtggtgagccaagattgtaccattgcactccagcctgggcaacaagagcaaaactgtctcaaaaaaaaaaaaaagaaagaaagaaagaaaaagacaaagaaagaaagtaagaaagaaagaaaattttttttcacttttgctcggcctttttatcaaggaaaatcccaaaagaacatttactgtaaaagaacattgactataaacatctttctgtgaatccttatttctgtcccagccaccatgacccaataatctctaaaacctgttagtgttctccagattgaagccttccctctaactgctcctaaatctgtgatgtagtggaaaaggtttgaggccttgattctcagcccaggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttagaagggttatttctctgcaaactatcctctctttcttatgacaagctatttctgaatgtgcacatttgaggctaagcaaatcacttcctgggaggtgtgaaagacctttatttctctccagaggagtattatggaggtggtagagacctagctaactcatctgcagcggctttgagcaaggcttttagaaccataaggtggctggggtcctgtgtcctacaccacaggccagctagttcatttcaggagactttcttttcaatctattattactatcttcttctagactgtagttcactaccagagattatccacttagctgcactcagtttacacctggcctgtatcaccacttagctctcactctagcctcagttaggtatcagcaagacctcaccaaagattattgtttcgttgtatgtgtgtgtgtgtttttgtttgtttcaagtagcaactaatgttggaactatggaaagttcttctctacttttaacaaagcttagtcacaaacagttccccagttgatgagaaaaactaaaacaacagaacaattgaaagtccaaatctgaaagctccatctctgagaagcaaattttatagccactccagatttgtattccaaatggatagtttgattatagaaatcacatcccttcagtctgcaaatgtgataactgaccaagagacagtgatgcctagatccataaataatcccctttcccccaacctatatataactggagtcaacagcagctagaggaaaatggcaaggacttggaatcaagattaagttagaataacactgctgtagactgttcatcagctcttcagcatatgtccattttccttgagggataagcctttagaaacctctgacaataaagtttattttacacacattctcttgcctatgatttttttgtacaaatcacaattacaaaactttcttgctccagctaaaagcaggaaactcagtcacaaatgtgttcactacatgtataccacagaatgatagcagccagtctgaatgcatcacttgattccaaaattaaatgttagcactcagtagtgaaactacatgtatctccaactctggaagccccaggcaagatactcctgtttcctgcagggaaacagatctataagcagggcagcagtctcacacatgtacattcctgggaaacccaaggaaacaatgatagtgatgcagggcaggcgagcctcaaaactggtttgtagcccgggaaatttcttccagactgtagtttccttggctttgccaaggaaagaattcaagggcaagccgctggtgaaagaaagcaacttttattgaactggtgctgctacttgcagagcagggctaacccataggcaatgtgcccagagttggtgcctgtgggctgctagctagttgtttttagacccacttttaattacatgccaattaagaggtaggttattcagaactttctggaaaaggggcagggagtttccagaaccgtataaagtaacttccaggccattgccaaggtgtgttgccatgacatttgtaaactggccatggtcccggtggtagtgtctttatgctcataagtagtaagagcaactagaggtcactttcatcatcatctgctggtttcagcaggcttcttcactgcaccttgttttgaccagatcctgctctgttcaatggggttgtgactggaaaataagtccttctggtctcctacctcatttccccatcagagattatatactcctccttaatcttaaggggcttgtagaagggtggaggttcatcttctgtaactgcttcctgctgatgttatgggcatagaacctgcctagcactggagaagtaaaatctctggatacctgttctaaaagacccaaaggcaggatgtctttattttctgggtcagaagaggggatgggttgaaagccttgtgccagcatcgtctttacatggaattattgtaatctagaagacacaaactttacaaggaggttaaacaagcaaggaccaaagattagtaataacaagatatctgttaaaggtcctaggaagggtaaaaatcaagtgtctgctggtagagattcctttattgaattccatcagcagggcaaagcggtaagagagaaaacattataattaggagtaagagaaaaactttcatgctcatccacagcatcatgttattaatatttatctgtgcatttgcaaaacaatagctttaagtcttctgggagtttgcaagtataggtcatggcatcttcctctgacatctgtgaggactcataagaatctttgaggctgggcacagtggctcatgcctgtaatcccagcactttgggaggctgaggcaggcatttcacaaggtcaggagttcaagaccagcttggccaacatggtgaaacctcatctttactaaaaatacacacacacacacaaaaaattagccaagcctggtggcacgtgcctgtaatcccagctactcaggaggctgagacaggaggattgcttgaacccagaaggtggaggttgcagtgagccgagatcgagccattgtactccagcctgggcgacagagcaagacttcatcaaaaaaaaaaaaaaaattaactttggagtttaacagcagtgggagtgcttaataatgcctgataggggccctttctattttggttgtaattgattcttgggggatccttctttctaagtttttagtaagactaagtctcctggttgaatgggggagttaatccttttccttgtgggaagttacgtttcatttccatatgattgaagggccttttgaacctggcctaagttgataatctatgtgtctcttcatcaaacagaaggtctaaagttaaaaagggccttccgagctgctcaggcgacccagtgctcggttggcccgggccgcgcttaactgtcccaggtcagttaagcccgtgggagcccaggtcatggggcagccagggcctctgcagtgtgaggcgccgggctgcgggcgggcaggcgggaggcttagggtgggtcgcggtcgcggcccccgccgcaggccctggcggcggcatcgtgaacatagacgtggagttccacatccggcacaactacccctggaacaagttgccggccaacgtgaggcagtcattaagtggagatagctcatcatggaggtcttcatctttgtcttcacatcaagtaggctgaggaggaggaaatacaggaagtattggtcttgctgttcagagtggcagaggagaaagaaaatcccagccgtcttggaaattcacagagagaatatgaaaatcaggttgtcctgtacagtatctgcaatcagttacgatacagaaataacttaaacatgtcaagaaagatgaacgcagatactatgaggaactgctaaactacagccgagatcatctcatgctgtacccttaccgtctattggatattatggtgaagagcttgagcataacaccattttcatattacactgggattatggagaatattatgaacagtgggcacaattttactgctgctgactgtctaaggcttcttggcataggaagaaaccagtatattgatcttatgattcagtgtagatcatcaaaaaaattcttcagaaggaaaacagccggtgatcttctaccaataaagccagtggaaattgccatagaggcatggtgggtggtgcaggctggatatatcacagaagatgacatcaagatatgcacttggcctgagaaatgtgctactgataagaccgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaagaatgctgtttcaatgtattgctgattgggctttgcccataagaagggacaagtaataaatttggatcaacttcattcatcatggaagaatgttccatccataaacagattaaagagtaccttagatccatagaagatgctcttgtcatggggtggaggggaaagtaggaggcctgtacaagaagcttcatcggcaactgacactgatacaaatagtcaagaagatccagctgacacagccagtgtaagaagcctgagtctgtctgcaggacacacgaagcacatcgcattcctgtttgactccactcttactgccttcttaaagatgggaaatctttcaccagttcagagcactggtgaaagagaagcacagagatattttgatcatgcgcttactctgagaaacacaatactgtttctgcgtcataacaaagatctagttgtgcaaactgcacagccagaccaacccaattatggttttcctctggatctcttacgctgtgaaagccttcttggtctggaccctgcaactggcagcagagttctaaacaaaaattacacactgcttgtttccatggctcccctcaccaatgaaatccggcctgtcagcagctgcacccctcagcatattggaccagctatcccagaagtcagctctgtctggtttaaacagtacatttacgtttatcatatcactggacaaggaccaccatcccttttattatccaaaggtacaagacctcgaaaactgccagatatatttcagagttatgatcgattgctaataacatcttggtgtcatgatcctggagtagttcctacctcaaatgtgctcacgatgttgaatgatgctttaacacattctgcagttttaattcagaggcatggtctgcatgggataggagaaactgtccatgtcccatttccatttgatgaaacagaactacaaggagagttcactcgtgtcaatatgggtgttcataaagcattgcagatactaaggaacagagtggacttacaacatctctgtggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccactgttcagttccgaattaaaccggaaagtttataggaaaattgctacacatggcctttgcagaaaagagagccttcaaaacctcttacattccagtagaaaactctctctgcaagtccttaactttgttcactcattccaggaaggtgcttcaacattggatattcacacagagcccagtttttcaagtttgctttcacagtcatcgtatgctgacatgggtgttccacttcctgcaaaaaatttaatatttaaagatggtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgtggagcaattcttgctttactaatattaaaagtttggggaacatattcatgttttctgaagttttgctccttattgcacatcttattgcaacaaagtgctttttagcatccagcactgtattttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcaattggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcatcctgatttatttttttgtttcttacctttgatgttttcaaaccaaggattgtgattttaggttagaattacatattagaaacattaagactatgtctttggatcaaaatgctttagtgattaacctactttgaagacatactcttaagcaatctgtatcttaaatttatgtgaatacatttttagaaaatgataaagaaaaatggaattacttcaaagtgtttcttgagtcattgattcttttagcatctcaaatgttaattagaataattggaatcactttttaaacttttcaagttaccttccttgggaagtttgtgtagtgttacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtatgtatgtaacttttacagtttttcagctgaaagttgtatttttttttaatcagggctctttaatctcattttaatttcctttgtttgaatgaactgtagttattttctgtattcctatattaaccatctaaaccaactgtaatgacacgtacactaatgaagaattgaacatttgtatttgttggcagtgagcccagttgttggtgaatttaaagcttaaaatatgggagtgatttgctgctatatttcttttgagagataaaggaggaagaaatggaacctaatggtaatcatgaattttagggaaagtactgaaaaaccatgcggtcccctctggtttcttgtgttgaatgaggcaagagtaatcatctgattcttagctgaagacttctcatactctcaaggagggagagtgcatttttagagcttttagcaaaaatgtgaaaagttcatgtttgcactttgctttgtgaatttggcttcattttacttatacattaactcatgtaatgtcttcaatcttacaagtattgatccatttcaacaaaaaggtaaatttaaaatgcagactttgttacttgtcaaagaagattcatgaaaaatttatatccaattattttccaaatagttaatttaatttggctttttaccacattccttcctttctttcccgacttctttaatgtaatttaaaccctggaaaacattctttagaaaccaagaggaaaagaagaacacatatcaaaaaagacatataacttaaaatggtacatttcacatctaaaatgggtttgaagaaacgcaactttatatcattaaaaaataagatcatctgatttcctttatttcttttttaaattatgtaatcagatgattttatattttttggggggggcggaatattggtttcttttacttgatgttttcagttttctctggcattcaagtttcttttttgtgttcagtgtttcaaatacaatttgtatttaaggattttaaaataccaaactgtaaatgagtacagtggatctttttctgttaggatgttaatattatacaatgaaatctataaagtgttgtcaatttgatcattgacacatatgacacgtttacaattaaactgtggtgttgatcaagttaaaaaaaaggcggaggccttccataagtcatttcaaatggactaagctttaaagttctctttggagccatcctcacatgcaaaagggttatgagtaggaggaaaactcaggcctctgaggtctcctgaaagagttttgctaatgtcacaactggctttctatgttatctgaagattgagatctccatgaagagtgaagataggtagtgcttaaggctgaggcattacctcactgggtcaccttagctgggaagggaggtcagttatccccttgcaaacattttggtaatccaaatcttgggatgatttctttaagtaagaatttagacacttccaatacttttcttgtccttgtggggaaagcttctatccacctggtgaaagtgtttataaatactagcaaatattgtagtcccctgtaaggtggcatctgggttaaatctgtctgccagtcttcactatggtatgttccgtggtgttgtacaagtttaagcagggagcggggtatggggtggcttcctgattggtaaatctttttatagtttagaacagtcccttccccaagaatatttaggaaactaatttgaatggaaaatcctgtcccaaatgtgaggaatcatgaaaatgttaaattatttcccatttgtcagcctcaggaatagagtttgttcttttctagcaagcgtctagaggggtcttactggaagccttttactcagtccctttaatttccttgggtgtatagtacggttccactgacatggatgacctggtagtagcgcagcagcctgaaataccagggtttccttagctgtggccttagctgctctttccaaaagggaatttcctctaataagaacagtgtctcccttctggtgtcccctgcagtgaatacttgttatttctttgggaattggatggcatctaaaagttccaagatctgagtaaagttgtatgggggatcccttggctcttgatagtcccctttccttccctatggttgcatgagcctgaagcacccggaaaccatacttagagtcagtaaacacattgactcttgagggttttttttttcttttttgaaacggagtcttgctctgtcgcccaggctggagtgcagtggcatgatcttggctcactgcaaactctgcctctcagtttcaagtgattctcgtgccccaccctcccgtgtagctgggattacaggtgcccaccaccatacccggataatttttgtatttttagtagagacagggtttcgccatgttggccaggctggtctcgaactcccaacatcagatgatccacccacctcggcctgccaaagtgctgggattacaggcgtgagccatccaacccaggcttaagtcttttcacagttggaaggtcctgattagagcagctaattctgctttttgagcagaattctgagaaggtaaacccttggcctcaatgacttcttgttagctaaccttcctttcttactccctcatgaataaagctatttccatctctaaaccactcaacactggggttagacaagggcttgtcttcaaggttggaccttctagagtagatctcttccatggtttccacccaggagtcaatgagttggggatctgtttcttgggatgtgaggtccagcaacagagtagcagggtttaaaaatcagcatactttaagggtaacatctggggtgtcaagcagaagagcctgatatttaagtaactggccccctattagccatgggtatacttttgcctctaggaccctctgtactgtacttcatggggtggtggggggcgggggtggtatggcatctacttgttgtcccaaggtaaacttactggcttcttccaccaatagagtgatggtagctacagatctcaagcttcctggtcactcagctgccacctggtctagctgtttagagaaataagccactggtctgaggcaattcctgacccttcgagttagaacatccaaagctgtcccttgttattcatccacatagaggatgaaaggtttttctaagttcgagagtcttgaagcaggggctgtccctggcttttcttttaaggctaagaatgccttttgacagtctccattgcaattcaaaggcttatgaccactcacttttggaggttcatagagtggttttgctatgagcccaaacctgggaatccaaacccagcagaatccagctattctcaaaaaagaatttgagggacctggagtgccaggatggtctcttttcatccctgggtcaagatcctggtcccaggagtgagaatgtgtcccaaatacgtgaccctttggacagaaatttgggcctttcggggggatacctgatacccttgttttgtttcaaaattaaggacttgaagttgtatgtttctcagagtcttcccctagtagggctggaaattaataggtgatacacatatggtaagagggatccattaattaactgtagttcccatacctcttttgccaatgcattgccaaacagatggggattgtcctaaaaccttggggacaggacagtccaggtaagctgagatgcagcatgagtgtctggattagtccattcaaatgcaaaaatgtattgggtgtccaggtgtaaaggtgtgtgaaagaaaacatcttttaaatttaatactatgaaccaataagcatcttcagggacttgagttattattgtataaagattaggaactattgggtgactggaactaatgcctcattaactgccctaagatcctgaacaaatctatattccccgtttggcttattaacaggaaaaatgggggtgttacgttgggactgataggattgcaataatccatacttcattatcaggggatggatgccccttggagccaaaggtctaaaaggatactggatttttctttttttttttttttgagtcagagtcttgctctgttatccaggctggagtgcggtggcgcaaggctcactgctacctctgccttccgggttcaagcaattctcctgccacagccttctgagtagttgggattacagatgtacaccaccatacctagctaatttttgtgtttttagtagagatggggttttgccttgttggccaggctggtctcaaactcctagcttccagtgatatgcccaccttggcctccgaaagtgcagagattaaaagcatgggccaccacacttaaaaggatatttttttccccatagataattaacactgggtttcaaaataacctggactgggagaacatttgcagttcttccaggaactaccatgtcacaagcagacgggtctacttgagaagtaatatttgatggaaggaatgacttttctttatctgtgttaagacatgaacttagagctaggagaagtgtcccttcccagcctgtggccttctcttgaggtgctccaaattgaactgcagcctgttattgggaaagtaagtctcttcccagcaaaggaataaggcactcaagactaagcaaaaatctgtggaaaaacatggttccccacagtgcaactaaaggaatgggtgaatctcctagcttttagctggtcatcaatcctcattacagtacaggagtgggaagacagtggcaccaaggactagatcagaactgagaaggcggctcgcatatccaataactcaatatttttacccgccatgtcaagaattacctgaggctcttctgtagagatggcaaggtgtctggtggaagctgtagggaatcttgggccctgtcagtcctctgttctcttagccattaggggtccaagaagctcagactccgtttggagactgaggcagtctttcctccagtggccctcttgcttacagaaggcacactgattccagcctaggggatgatgagctggcttttgtctgggcatcccaaagccactcttgcaacactttctgaggatgggcagctcaaaagcagtaggaggctgaaagcagctgcaaacaattgcattttttggctatttcttttggttttatcctcttcctctgccttgtccctattgttgtaaactccaaaggccatgtttaagagttggctcatggagtttggggtcccattcctgccttttgtaacttcctcctaatgtcaaggatagattgagtaatacaacgcatgcccagaagaccccacccttccgggttgtctgggtctacattagtatatttcctgagtgcctcaaccaagcagccctaaaacagaatgggattttcatccttccactgagttacttctctatccttgtcataattaactggcttaatcacacaccttttcatactttctattaaacaagttagcatgtgatttctatgttcaagttcttgggaacccttctggtaatcccactgagggtctctatgtggaactgcatctccccctacataaatggtatggccttggatatgagcagctactctaactgcatattcacaggccagtacccagaatccctctcttctcctctataatacaggaagaggacaataatatttgcaagttgtgccaagttaaatcaaaggacatcatcaacctgacaaactcctctataaacttccctggatccttcaaaaaccagccatatttctccttgaagaaagccaatttggacaaaggaaatggcacatatactctgattgttcccctatctctgccagctaactccagcaatggacacagattcaatttgaggggctgatagagagctccactcctggtggttctggttgggcttacttccttgggcagtggggatacaggctggagctagctaaataaaagggagggttttctgatgacattggggtgaaatcccacactggagaactggcaggacccctcgcagaactgggggactgagaagaccctggagagggcatgggccctccagggggtgccgccaggaagggagcatcgaggatatcccacgcggtttcttggtgcctggaagtaacatgagccagacacatcctgcagttgactcttaagtcagaatcctggtagggggccgtagaagcctgtacgtaaggaacttctccccattttccttcctttttactgaataagtccaattgtaaaatagtatgataatgtaaagaacaagtttcaggccaaatttcttgttctcccaagaaaattgtttctttttctttgagccatctcatttgaatttgctccaattgccttaaagacaccctagtggggagtcctttgggatgctcgcctttgtccccatgtctaacaaggatctctactacacccagaagtttttctaagtctagcaaaagctcagttactttccctttcaaattcccacctcctgcagagatgtaagtacagttagcaaagtgttatgaaagtagattatgaaatatgaatgcgaagtaaaatgatgggtctgaattccacagagtgaagaaagcattttagtttgggcaaagaggggttaaaagaaacaaggtgatcatggaagggaggaagggaaagcatgaacagcgttgtccagactgaggtgccagaaaatctacccagcagccacagagactgaggaaaattatttgggcaaaatgtttggatggctgctgcttgtctgccactatgggtagttgtcacttgggccaggggtccaggaatccctggtccctgtgaccaagagttcaatatgggcttgagcaaagtcacgtaggagggggcccacaactggctgttatggaaaatcgtaatcttttaatttaagggcggagaagatgacatccacactcctccagcgaaggagctctaatccacaatcctatagggaatgtcaatgctgaaaaccccagagcatccagggagaggccaacagtgacagtggaactctcaccacaacgaaatgccaaaaacccagagtacccaagtatcagccagtgatggtccccacactgaatgctgaaactgcaggggaggcaatggtgaaccccaaaggccaagttaggggccactgaacaatgtgactttggcatctcagggtcagcacagtaagggacttttcacgaccaagtgtcctgccttaaacagttcttgactctgtcctgtcctgtcctgtgttatatcatgtcctgtcccatcttgtcttgtctttgtggtcaccagatgatgcaaggaaggacaaccccaaaattggggcttagccaaggagagttcttggctttgcccaggtaagaattcaagggcaacccagcggtgaaagaaagcaacttttgttaaactggtactgcttctcgtggaggaaggctaacccatgggcagtgtgtgggttgctagctagctgtatttatttagatgcttttaattagatgctaattaggaagtgggctattcagaactttttggaaaagggatgaggagtttccagaagcatataaggtaacttcctggccattgccatggcatgttgacatggcatttataaactgtcatggcactggaaaggagtgtctttatgctaatgagcagtgagagcaactagaggtagcttttgtctccatctgctggttttggtcagcttctttactgcaccctgtttggaccagatcctgctctgatcaactgggccacaaccgcaaataagtcctgccactttcctacctcagtagaatctctgccaaagaatgatcttgaaagtttgctgtttactcatcatctggaaaaatcttcctgtataggccaaattcccacccttgagatttctgaaggaccaacaagtaaaaacagtatactccaatgggactgttagatttcaactaacttactctcctttggatttctttttctgaaaataaattcttcacacacactgacttgtcttttgcaatccaatgtaaaagtgggacatcttcttcagaagctttgaaacatacaaattagcctcaaacttacctaccagacttccaggctagaaggctgattcatgtaagaaggactaagaagacacttcacccatatcctgggtaacaggaggggatcctttagataggtttgtacaccaggctggtaacctacactttcttctagcagtgagaggtactgagatccgtcaccccctcctgcaaggccaagacccagagagagccaaattttagcctagaattcagccagctcttcacagtctcctatgttttacattttcctccacaatcatttactttgaaagacttcaaacctatagaaaaattgaaaaaaaaagaactcctctacaccattcacccaagttcaacagttaacattcctttaccttttttctctgtctacacacacctacacacacattcatatttcatagtaaatgcagaccaaaaaaactccacttcatccctaaatagttcagcatgtatttcatgagattaaggacattatcctatataattataatacaattcaattatcaaacctaaggatattaacatttattcaataacattatctaatatatagtccagatagaaattttctgtttagaaaatgtcacatctatacacatatatgtgcatgtatatagatatttatgcatacatagtgtgtgcatgtgtgtatgtatgtgtatatataacacacatgcacattacatatgcataaatgttttaatttaataatatttatatgcatcaatatcttaaagatatatacgtatcattagctggaagctgcctctatccatatattaaaggtttctccatatgtagtgaactgtaacctaactggatgtgtaaacaacctgtaacctactcttgagccaatgactgagttttagccaatcaaaggtggccaactgttcaaactgggttcaaataagacaaactcagagctgtagccaatccgattatttttgtacctcacttctgttttctgtaagtcactttcccttttccatccataaatcttcttctaccacatggtagcactggaacctctctgaacctattctggttctggaaatttctgattcaggaattcttctttgcttaattaaactctgtgtgtgtgtgtgtgtgtgtgtgtgtgtgtgtgtattatatattatatacacatgtaatatatatatgtatgtgtatatataatatttatttaagagagagagagaagtgacttgtggtactgatgttgcttccctaggttccaagtaaagttcctcaattgcactttacttacctagagctgtccctccatttctttgtccttgttgctaagtttttgaagtggataggctagttatcttgttcaacatcctgcattctgatcaaactaaacatttttggaaagaacagaatataggaatttgtgcttcttaccactcaacctgtcagaaagcaagtgatgcaagaacaaaatattgtgaatatgtttacatcgaaagtgttaaagaaaactcagcatctgccagcaagtttatggcgtgccacggtggtatagtgattggcactttgtgttgtgaatgcagaaccttgattccaatccaaaatggcagtgtgtggcatctttttggggagaaactgagctgtcttttggtttgttttcaatccgtgcactgactgagtcctttagcagggtttaccactgactcctgcaatgcagtgcagtcaggcaaaaaggagaccccacattgcacatacctagggcccaggacatgccctatgtctcaccattgagcagaaaatatcccaaagggtaaaatgtcacctttcaaaccgccatgttggtagcttccactaatgcagtggtgtggtcataactggtttttactgttccttacaatggctgcaacccttatttgtgactagagaacaaggcttaccactgaattgccagcatgatacagccagggccatcaaaaacacacctgcactagatcattgggaactttggaggtgccttacatctgggcatgcattgaaccaccacacaaggtgaaatgcctcttctcaaagaggcttgcctgcagtttccactaatgaaattgtgagtcatagctgttcttctgtttgagatattaggagggattttgtggggggtgaggggggatgaaagtgagcttttactgagtttaaaataaaatccaaactccttgccatggtctacactggcttgtctccatcttccatcccccaccccccatgtttatgctaaagagcagactattgaaatgtaattcacacagtgtaaaattcaaatatattaactaggacaggttattaaatattgacaaatgaaatcatcacccagatcaagttatagaaaatttccatcatcccaaaaatgtctgtggatgccaggcacggtagctcatgcttgtaatcccagcacttgggaggctgaggcggaaagattgactgagcccagcaatttgagaccagcctgggcaacatggcaagacccccatccctataaaaattttttttcaaattcaaaaaataaaaaatatttaaaaaggtccaagagtccctttccaggcaatcccacccttctccccttggtttatcactattctgatgtttatcaccatagattatgttgctctcttcttgaaattcatataaattcactttttgtgttagctttttttcacatctttgaaatgtatccatattattatatgtatctagtttatttgggtgtaactggtgagtgttatccaatatgtgaatacaccactgttgatggacaatttggttatttctagtttggactattatgaagaaggctgctgtgcatgaatattattgtacgaatctatttatcaacaaatattctgtgttttcttagattttgtatttgtctctatttggcatctattcaccgcagaacaattataataactatattttcttattttctttatttttttcttaaaacaatttattgatgtatgcctggtatactaaaagctgtacatatgtaatgaacacaatttgctgagattggaaataagtatggacacattaaatcatcaccacaggccgggtgcggtggctcacgcctgtaatcccagcacttttggaggccgaggtgggtggatcatgaggtcaggagattgagaccatcctggctaacacggtgaaaccctgtctctactaaaaacatacaaaaaaaagattagccaggcgtggtggtgggcgcctgtagtcccagctacttgggaggctgaggcaggagaatggcgtgaacccgggaggcagagcttgcagtgagtggagatcgcaccactgcactccagcttgggcaacagagcaagactccatctcaaaaaagaaaaaaatcatcaccacaatgcatacaataaaactattcagctgggcacagtggctcacacctataatcccagcagtttgggaggcccaggctggtggatcacttgaggtcaggagtttgataccagcctgcctaacatagtgaaactccatctctaccaaaaatacaaaaattggtacagaataattatacatgtttataggagtacatatgatattttgatatatgcctacgatgtgtaatgatcaaatcaggatgtttaggatatccatcatctcagacattttatcatttctttgtgttgggaacatttcaaattctctcttcttagctcctttgaaatgtacaatatactgctggtagctgtagtcaccctactgtgctgtttcttttctgagattccacctaaccccttgatgttccaactgctgtggttgtctaaaactttgtcctctgttcctttaatctaggaagacagtttggttttgtattgtaatttagctaatccaagtaagggggagcaaagtttgttctataaacgaaaaataaaatcctaagtcccccaactgactaaatggaccccccgttggccaacgggaccctaggcaaaccttataaactgagtcccaggccaagaaggaacgggaggccagacaagcctcattatattcccacccttttgcaatttagacaaaactgaccaacattaatgttatcatggagatcataagactgacggaacagactctttatggcaataagacaccaaattataaataggacttaggaccattccgggcaaggattaactcacacaccccatatatgcaaagaataaactatgttctaactgccacaaggattttctctagcagctaaacaagcactggccttgagaatagggagtgttgaagcacttgctgctcacccctcaccagataccgaaccccgctgttccacaagccataactacagccttgactgacaagagactgatttcagtaactttcttctgatgagaagaccagcgaccatggactggttctgtcagttttacagtatctgtgcatttgagtgcctttgtgtcctgaaaagacctttgtgtatagggcctaattgtaatgcatttaaatgctaagtatccataacaaggtgaacaaggttgtatattacgtgaatgtttgttcaataagcatgcatcaggaccccttcacaaatattcataaatcctcctataacttgttgaatatgtattttaggcccacccattcaacttaaattcctgtcttgcccctccctccctcaaagtgcctgcttctgggcttcccgcgattcccagcctgtcaggatgaccaccttacatgctgtaaccctttagaagaaataaattctcctctgtaagctcacaaattgtatggtttttcagttaacagccctctgctgaaagtttgcaaaatgggatactcactacctgccattcttccatatgtccgcctgcttttgttcagtcttccagcaccttcaaattatataatatatatatgaaataaatttttctagtttatagtcgttatctgtgggagagttactctgaaagcagcaagaagccattaccagatgcagatctcattctgtcagtaatggcaacccagcaaatagggcaggagccccacccaggtgtggatcaatgcatggctgtataaccttgaacaagctgcttagtcgacctctgaagtcagtactgctgtatgagaaatggagatatgaaaagaacaggagtgctagggtgcccaagggagaaaagagtaggtaacaagattttcggtcaggagcatgagaaacagggagagggtcgccattaactccccttcttcaccagagttttctggcacccaagactgcagaaactctcctgcagtgggctttggggcacatcgcaagttccagtaacaagggctaaggtcgcccgcttttggagaccttacaaagcatgtattccctgaccaggaatcgaactcgagctgcaggcggtgaaagcgccgaatcctagccactagaccaccacggaaacaacagcaagcacttttcattcctcttgccttccaaaggtttctccaaaaggtgaacctgtctgcaatgctcacgaagcccgccagatgcacaagtcaaaactgatctagagattctgaagtacgctgtgctccttgagaagtgcggagccactggaaccacaagcagcttcagacaggaaccaatgaggccatcaaaaccctcaacagaggcatctgtgagttcattgtggtggctgcagacaccacgctgcaagagagcattctgcactcccactgctgtgtgaagagaagaatgtgctgggcctgcctggaatgtttgcgcactccaggcgggccctggggcgggcctgtggggtctccagtcctgtcatcacctgttctgtcaccatcaaagaaggctcacagctgatccagtccattcagcagtccgttgaaaggctcctagtctaaacctgtggcgtctaaacccgtggcctctgctgcacaatctctgctgactcctccccctgaggttattctcagctactttctattgctataaaatattatagtactaaatctggtttctggggttttgtatagtttttgttctgttttacagggttgttttcccccttctccatgcccaccctttctctgccatcctgcatcctcttcaactctctattgaaaaatgaacaaatgttcagaacagaggaagtagagtggtggcaccatcaaaggcaggaagggccaggagaacctgatgggagcggggatacagacctggttctagcttccagtcttccagtcactaactttctgctgtgtgcagggcacaatggaagtaaacaccacccactatatatcccctgtgcctggcatacagaatcattcacacatgttgaccgaagggtttcctttgcttctaggggattatgtatcattttgggaggaagcatgtattctgtgaggttgtttagtttatgtccaagcgccatttactaatgtatccctgctctttgctttcggtatgtatgttcttcctccacctgacaattgtgcccccaatggtggccaggcagcagcataccaaagagatgtgctgcaagatttcagaggtgggtgagtgagacatgggaaagtggactcaggtcttgaaagagtcaggagtggccagggcaaagaacatgaactggtgctggaatgaaggattctgggaaggttgtggagacctggctggtagctagagcagagatgatggaatccaaggaaacaacttctctccggtgaatcaagatttcttcagtggacacttagtcccagctctgatagcccttacccctgtttcctgccacagtgtgggtcatatgtattctttatcatatgaggagagtgctaattaatgtgtcatttattttgtgagcatgctaatacatatattcatattccaatttagtgaaaaaaaactgatctagagatgccccttttcgaggtgacagcatggctctggagagatggccacaggaaccatggcagtggaccaggttgctgggagaaggcaaaaggggaggcacccaagctgagaaggggctaagcactcagcccctgggaccaccaacagcaggcctgagacacatgcaggaaaccagacagcctggatgaaatttctttcaagcaaggccagtggtccctgacagaacaccagaggtttccccctaaatcctttcgcatctgtaccatttccatcttagttggagctctttgttctcatccttgcaatacgcagagaaaaaaaaatcacaggttgttgattgtttgaagatagggtattgctctgtcactcaggctggagtgcagtagcatgatcacggctcactgcagcctcgaacatccgggctcaagtgattctcccacgtcagcctctggtgtagttgggaccaaaggtgtgccaccacagaggcagggttttgccattttgcccagaatggtctcaaactcctgagctcaagggatcagcctgcctaggcttcccaaagtgctgggactacaggcatgagacaccttgcccagccaaccagagttctttttgatgccgatattttactcggactccacatctaggtaggaattcatgttttcaagtacggacattgctctacacaatcctctcctttcctgatcactaaattagagtaaatcactgtcctgaagaaggtacccttgggagagtgggttggcctgtctttccaccctttcttgactctgccctcaccttcaagcctctttctggcctgtgttcaaggtccagaggcatgcttaagacctctctgtgtggctcttcttgaagagtcaggaaccccatacttcctgttcagcgggcagagaagcttcaagccgcacagttttgggtatgctaggatcccacaaggcacagatgtgcagtggcccacgaagtgagtttgtgggtctccagttacctgcagccctttctgctcctgtaggttaaagggcaattgcctttttttttctgtccaggaaggaccccagaatgttctgagtcagaaagacagtgaatcctctcctctgggtcagtggggagggagagagagagatttcagagggaagaaagcagaaaaagatgtcacaaaattgcctaatcaaaagttaccatgatgcctgcctcatctggaactgggctcccagtctctagtgagggagacatagtccagtccagtcccagtctccagtctgagccaaagcagaacaaagctggacactgcagcctggcatccaacgaacattttgtcactttccccagggtgggagcatttgaactttggatgtgaaggaaacatggtaaccactgcagtaagaagagcaactgctggagaaaatggcactttcttccccaaatttgtttttacactcatgtctaaggaacaccttagaaaccacattaacatctttcagcaaaaggaaattctgcctgttgatcttttgctgtgagacaaacttgaaaagttcacagacactgcctttctctgaaaactgcccttacctctttgttataattcacttcaagatctgttgagtaggaacatcaaaaatgcaaataaaaagtttcaagtattatgaaagaatgcaataaaactgcctttaaaaaaaatctcaagatggaggtggagatcctgtgatcatgaaatctgaataggctgctcttgtgtccttcagtggtgatggctctgaaacccttgtgttttatgaacttcatgccctggtcttcaaacgaattcagtgcaggccaagaagcacagtttggcctgggttggatgctctatattttcaaagagtgaaatgtcttgagacacagcctttgctatagtacctgctaaaacttcaacgtgtggataaatatagcttacattgaatcgaatagactcagcgagagtggcagtgaaggatgccctctggaagattcgaggtgctgaggccaaagggctagcaaggaaagagcgtgcgggtcaggcccttcaacctggtggaagagcaggcagggagggtcctatggttcctgggaggacccgaagcatgatcgcctgtcaagagccaagagccctaatggccagcgccggggaaagggcccccgaggggcagtcagcagccctgcaggggcggcgttcacactcctgtgtggcacgggacactcatggctccaccagctcctgaagcttctgggagccagagagtcagcagggagaatcccacacacgggcactcagttcctggaaaccctgcatgagatgcgggatcccgaagccagattgggggtccctagggtcttggcttcggggctaggcgcggaaccgtaaatgagggttcagcctgtctgcctgagggattgtgtttcctgccgtatttatcactcaaattttgaaaagcagtcgaatttgttatattggaaaccctagtagttaaaaacagcagatggtaacatttcaggaatatgtcttgtgccaggaactgtgaggggtttctgtagtgtagtgattacatgttcgcttcacatgtgaaaggtctcaggtttgggacctttcatcatcaacatgatgaaaccccgtctccagtaaaaatacaaaaattagccaggcgtggtggtgcatgcctgtaatcccagctcctcgggaggctgaggcaggagaattgcttaattccaagaggtagatgttgcggtgagctgagattgtgccattgcactccagcctaggcagcaagagtgagactacgtcttaaaaaaaaaaaaaagaaagaaagaaaagaaaacagaggactttaaaaccgttattatgtcaatattctatgggtccaaagaattaagcagaggtatcaaacatataaaaatggtcagaatcaaactttggagattaaaaactacaacatctgagataataaattcactggatgcaattaacagcagattagacactgcagaaaaaaagattatgaaacacaaagccgccgggcaccgtggctcaggcctgtaatcccagcactttgggaggcggaggcgggtggatcacgatgtccagagatagagcccatcctggctaaaacagtgagacccccgtctttacaaaaaaaaaaaaaaaaaaaaaaaaaaatatatatatatatatatatatatatatatatatatatatatatataaattagctggacatggtggcgggcgcctgtagtcccagctaatcgggaacctgaggcaggagaatggcatgaacccgggaggcggagcttgcagtgagccgagatggtgccactgcaccccagcctgggcgacagagcaagactccctctaaaaaaaaaaaaaaaaaaaaaaaaaaaaaccgcactgaggggaaaagtcaatgtgaaattctacaaaagctgaaaattcactaccaccagccattaccacaaaaaaaaaaaaaagttgaaggagtcctccaggcagaacgaaactgacatcggatgaaaatctggttgtacaaaaaaaaaaaaaaaaaaaactagacatgacatctaatagacgaatatataattttaacatctgactgtttagctgggcgtggtggctcacgcctgtaatcccagcactttgggaagctgaggcaggcagatcacttgaggtcaggtggttgagaccagcttggccaatatggtgaacccctctctctactaaaaatacaaaaattagtccggtgtggtggcccacgcctgtaatctctgctactcaggagtctgagtcaggacaatcgcttgaacccgggaagcagaggttgcagtgagccaagattgttccactgcactccagcctatctggaacctagtttgatctggagggatcttattttataggaggcttggagggggaccttttgctttgtgtacttataggatgcacaagacacaagggaacaatctctcactttttaaatacagtgataggcctgaggagaaacaactgcaattttttttttttttttttttttaatgagatgggattctcactggtcttgaactgagctcaggcgaggcttcccctacgtcggcctctcaaagtgttgggattaataggcgtgagccaccgcgcctgaccacaactaaccaacatttaaaagcacgtccctgggtaggctcgaaccaccaactttccggttaacagccgaacgcgctaaccaattgctccacggagataacctcagttggtcgctttcatctcaacatagattaagcaatcactaaactctaggggttgccattcgctttctgcaggacaactgtgcagactacaaagcttcggaaaaccggagaggctgagtcgactaatcgtgttgttgcacgttagaaacgcttgcattgcctgactctgaaaccagaagggcggccgaatggccttcaccctccattaaccctcgcctccttcagaagccagtgcctctggaaatgcctggatctgcgaccccagcctgagcctagtagggcccaagggaagctgaacgccccgacggctctcatggtaggtagctctttctgtttttttgcgccgccttcaggcaatcatctactccgcttgctatcccctcactcaactcggcttcagtagatggggttggtggggcgggagtgggaaagaggcaggggagtcaaaagggaaaacctgaaaagaaggagggagaagaagcaggggagaccaggacgagacaatgggacagcccaggatgccggtgcagagggcagcggctggatgcagagaagatgggacacgtatcagaatggactggagaagacgtgagggaaaatcacaagaacctgtagctgcccaagaataaacacgtaaaaatcgcataaatgtttttacattaaaaaaaaaatcgggagaccgggcgcagtggctcacgcctgtaatcccagcactttgggaggccgaggtgggtggatcactcacttgaagtcaggagttcgagaccagccgggccaacatggtgaaagcccgtctctactaaaaatacaaaaattagctgggtgtggtggcgacgcttgtagtcccagctactcaggaggctgaggcaggagaatcgcttgaacctgagaggcagaggtggcagtgagccgagatcgcgccactgccctccagcctgggcgacaaagcgaaattctgtctctcaaaaaaaatgcataaataaataaaagaggggtggggaagcaaaacgacgggcagtaggtgtggggcgcattgggattctatagtggttagtaccctgccttgtgcctgcagcaacctctgttctaatctgaatcctggtacagtcagactctatcttggacccactggggcgaacccacgagtcttttggtttgcttttaattcctgcaccagctgcggcctttatctgcagccagaaagcagggtttaccgctggccccacagcgccatacggtctggggaaaagaaggaaacccaatagtacacaaacaaaggcccaaagagaaaccttccaagtgctctatgcctcacggtttagcagaaaatatcaagcaactctcaacctagctggtctgtagcttccacaaatgaaatactgtattcattgcagcctttctggttgagatatttcaaatatttggtggagcttttaatgagacggagagacactctcgagtgtggaagaaaaacatgagggggtgtgaggataaggcgactttaggacagaaaaaacaaagagacaaggaagccacgtaaacgttttcgggtaggcgtgaggcgatgtcagttttgaaccccgtttatgttaggtagagagcgcagccctcttctagcacaaacaccgtttcccacattgaagaaatcacagagatcagcaactctagagtgcgatgaagaagcttcactctgggagaacccccttcgtgaccacggtctctttcctgccaggtaagtgggaatgagcgcatgccctgcagggacagcacagcgtcctcgccctggtcggacgctcagggtcaccaccctacccactgcccccttcgccattcttccaaaccactctctgccaaagattccaccgacagtcaccccacacgacaacccaggccgcctttcagcagtggctcccgccccgcaaccacgcgccctctcacccccgcggttctgcccgccgcctctgtccagtctgtgcacttcacctccctggctcccgctctcccctgagcttacagtggacgcggggttcttccaaacccctcttgggaatactgaatggaaaagggggagcgtgcgcaagtgcttggtagagtgtagacattgtgggatttgactgtggtaccatcgctttgacgtcctagtgctgatttttacacctgcattctgcttagggcactggcaacagttttccgtttgtgcctactccacctgctgtctttgttgggtcagcgaacatcgcctccctctaccgctcaatcagcaaaagggaccgcccttgaggacctcacccgccgctcactcccctcccaacttcgcgggcatcgcctccggtcgcctcttccgaaggcctaacgagcatgttagctgcgaacggaggtgaggaggctccgctgactgaccggtgcccacgtccagggcacgcacaaacgccatgacttggcttggcctctctcttagttattcacagctcagcccgataggcacctctggggcggcgacggcaaagagggtgcgcttattaagtgcagctccacggggactggcctctctgcacggctgtgtacacctgagcgagacgctcagtcgctctctaaagccgcttctgcggatgacagacacggagataaacgtgagaggtggcccaccacgacttgccctcctttgcccgggtttgcccctcgctgcggaggctgttctacatctggcccttggagcaggccggctgacagcgtggtaaaggaagatttctgcgggagggcggccagtgcaaaacaattccctgaccgggaatcgaacccgggccgtggctctttcagcaccgaatcctagccactagacaaccatgcagatgcggaaagctgctttctctcccttcttcgacctgaagcgacactttcctgtgctctaggaggacttgggtcttgtgagagtcgccctttgctcctggagtcgtctcacaaggccgttcactccctgctttcttcaaaaaaagaacctgcaggcgacacaccaaggactccacgagggagtcctgagtactggagcgagttgcggccacgcggccgcagctcaccactggcctagagatgccctttgcgaggcggcagcaactgacaagatggtcgcgggtcgccgggtccggagccgcccaccaggttgccaggaggaggcgggagcggggaggcgcccgaggtgagacaggggcaccctctgcatcataaaggacccagaccccggcaccctcaacatcataaggaatcagacggatgcggaaaccgagacgggctggataggaaactctttccaggaaggctccggggcactcaactggtctccaaccttcccctgcaacctgtgacgcctgccattttcccattttaggcgatggcaacgcaacccctccgtttgctctgggcaaaacttcgagagttccctctgaagctggagctttttcctcagatccaagatccaattggtcaccaattcgtgatttccgtcggccaagtgcgtgggcattgatctacacgcgagtttctccacctctgccgaatggctacttcggggtgggggaggggccctcccgccgtggattgcaaggtgtttagcagcatctgtctcctccgctgactagacacatgccagggggataacattctccctcccgcttcccccagccgcggcctagtgtcccagcggggttgggagaggcatgtgagggcgaagttgccccctgttgagaaccattgctgcgcgtagtccttctctctgaacttgtgcagaggactctccaggtgaaggctcaagggtggatccagctcgagacaccctcgctccccctcacagtcggaccttaggatttaggctttaacatctccacatcatgagattcgaaacctttaggtcttgtcttccgttctgtcctccaaatcggcctcttccgagcctgttgaccagggccagccgggcagagggctgggctcgctcaacgaggctcctctcgcacctcctggagcttcaggcttctttccgttgcagagaagctttatgggccaattcgttcggcatccccgggggcaggtgcgcggtgcgcggggaagaagaggatttgactgcggttctccacccccggcgcccaacctccaccccggtgcgcgcgctcttccaggctcctgctggtcccacttgccaggagttaggtctcaggtcagcctgagctcctgagacgcccaggcccggaaagacacgtaggggaaaccatctgctcacttctgtcctgtccggaagggatccctttctgacgggaaagaaaggcggtgagtcctgtcctgttgagtaggcggaagagagatcaaagggaagacaagaaaaatcctgtgagttttcaggatctaaagttaccatgaggtcgacctaacctcctctggaggtcctcccggtcctcccgtggctgtcgaaggtgaatctagcttccgtctccagttcgccaaggcggacaaagccgacgacaatgggcctgtccactatcttctttcatatgcacaaaatgtcagctcttcttgtttctaacttgcaacatcccacctgatgaccagctcagcaaattagagaccctccatgggattccatctctgtcttagttcgggcttccataactatataccataaactgggtggctaattcacgacagaaatttatttctcacagttctggaggttggaagtccgagatcaaggtgccaacatggtagggttatgatgagggacttttttctggttgtagactgccaccttctcattgtatcctcagggggcagagagagctccctggggtcccttttatagtggcattagtcccactcagactaacgggactaaatccagacccagttattgcaatgtgtgcaaaagaacaaggacttgtactatctgacttcaaggcttactataagctattacagacaaggcatcaggagggacaaatagataaacagactgagttaagagacctgaaactgatccacagccatacagtcaataaatgagctttcaatgaaagcagttcaatagaagaaaataaatcatttcaattaatggactttcatatggaggtgggggagaccaacaatgttattctccctcacactacatacaaaagtaatttgaggtgcattatacaccaaaacttaaaagttaaagatataaagcatttcaaggatactctgtaggtaaagattagcctaccaacaagtaggacactgaaaaaatatatataaaagacatgataaattagacttcatcaacattagccataccttctcatcaaaagataccactaagaaagtgaaaaggcaagcaagccacagacagagagaaaatagtcacaaaacgtatctgacctccacatcctgtaattagaattattgtggtctggtacactgcacccagtttctgcaggagtactttctgggtgtctctaatgagtaagagagggccccatgggatattcctacagttcccagatgaacagtgggaaagactctacgttgacaaaccccggggacctgaaaactcaggtcctcaaggagggtagaggatacctggaccctgacccagacccctagatgggctgtgccaagagacccagcaagggaagggattccctcctgcctcaggttctctgttcttctgtggttagaagacctgaacccaactccctctccaagcagtggagatagggcttttccaagggctggggatcttgctgtcctaaggacagctgagcaagggggtcgaggaggagcttgggtggtggaggagaggaaaccgggtaagatgtgtgaagcagtcggctataccaggcacagagaggacccactgggacacaagagcctgcatgtgaagccaggccttgggccaccttgttcctcaaaggggtgcttacttccatgggatcttcaaagggactgtggaaagagaagccttcagcccacacctctgaatgcttttccaccacagcatgccctgtggcctgtatcctgctggtgtggaacagtcagacccctgcagggctgcagagcctctgtactgggcggcatcccagcctgagtgccagagctcagtgggcaggcccccgagcaagcagagaggagggcaccttttggacagaacctgtgggacaagagcgacgtctcatcctttcaggttcctcacaaaatgacagtcaggaagatcagggtgcagacctgatttcccacgaagggctgaaagcagacaaccggagggagagcagcacctgggccaatgaggtagaagacagaagaccacagtgtacttctgccctcaacctcaccccctcccacctacatcctccacaccccctgaccaccttcttcagaaacgtaataggaatcaagatcccccctggcctggttgctatgggaggcacagtggcctgatggagcctgaggcaggtgtgggaagatgtggattgtctaactggaggttgggagtccagggtgcagaaggagaagcttggagtgcaggatttggtggtatgtgtgtggcagtaggcactatgttctaattgccagtttttttttcttcttcctttttttctctagctaaacaagcactggccttgagataagcaatgctgaagcacttgcagctcacctattaccataaactgactgagccctccctacacaagccgtaactactgctttgattggacaagagactgatttcagtagttttctcttgataagagaccactggccgtgggcgggttctggacagtttacagaagctatgcacttgattgcctttgtgtccctgcttcaccttttgaagcatagggcctaattataatgtatttaaatgttgtctccaccccaaagtgaacatgggttgcatgtaacaggcatgtttactcagcatgcatgcagcaggatcccttcacaaatattcagagctccccctattccctgttgaatatgtatatgtggccagccagatcaacgtaaatcactattcgccctcccctccctggaaacctacttttcgggtttcagcaggaagctatgcctccccgtctgtcagaatggccacttgcaggctgtaaccctttataaaaaaataaaatctcctttctaaatttataaattgtgtgatttttcagttgacagctttcagttgtcagtcaagtcattgactgggaaaagtcatttgcaatatatttatttgaaaaatgactcaactcctgaatatataagagaactttcataaatcagtaatatagagctaagccaaataaaatcgggcaaaatattcgaataggcctttgcaaaggagaatttcttatatgctggaagccataagaaaatatgcttcatagtattgctcattaggcaagtacaaattaattccacactgagataccactaaccaatcaccagtgtgtggctacttttttttttttctctgagacagggtctctctcacccaagctggagtgcaatggtgcgattggtgcaatcttgagtcactgcaacctccccctcctgagtagctgggactacaggtgcatgccaccatgcctggctaatttttatattttcagtagagatggggttttgccatgttggccagtttggtctgagagcatagctacattttaaaaagttagtacaccaaatgctgacaagaatttggtgccacttcaactgtcattgctggtgaaaaaacattctagaagactggcaatttatactaatgttaaacttgtactcaggtcgtgacccagcaattgaagtacttccatgaatctcaagtgcacaaaaagacctgtagaagaatattcatcacaagaattcaataacaccaaaattgagaagtgatctatgaaactacgtggatatatctcatgagtataatgaacatacctgcagaaaaaaggccagatacaaaagatatgtccattcactcatgtgaactttaagaacaggcaattgtaacctatgggaatagacatcagaatagtgattaactaagaggacacagggtgggaattgcctggaaaggggctctaacaggcctttctcagatgatggcaattttctataacttgagctgggtggtgattacattcatcaaaaataaacgaactgcactaaagatttgtgcactttatgtgaactgtagtttatttactgttctcattgcttgaacccgggaaacgggacgttgcagtgagccgagattgagccatggcactccagcctgggtgacagaacaagactacatctcaaaaataatagtaatagtaataatttactgttctcataaaaattagcggatggggaatggaggcaagccggtgtagaccatgacaactagtttagattttattgtaaactcattaaaagctcgttctcgttttgtgtttttaaaaaatcccactgatacagccgttttctctaccagatgagactataaccgtattatttcatcagtggaagctacagacaaagggcccttgagaggcggcatcttcacctatgggaattttttctgctccattgtgagacaaagagcatgtccgagttttcattttggccaggccgccccctagtttacgcactgtgggctaaactccagaagctggcgcccttccgggccagcggtttactccgctctctggaggctgctaggattaaaggcaaagcaaacgacaggtcttttagctacaatcgcaggagagaaaacactactgtgactcagattagaacccaggttgcggcaaccacagctgcaagtattgaccactacacgaccaaaaagcctgctgacaaccattgtacttcttatatttttttatgtaaaaacactcatactattttctctgctttattctcgaacgtctgcagattttcgtgcttttctctctttcatgcgcttctccgttactctctccccattccgctacataatttaaaaaacatctcatctctcaggacctggccactgcctctacaacaagcctcctgggaagtctcgttgtcccatcgacacctctcccttctttcgctccatttttttttttttttttttttgacggagttgctctgtcgcccaggctggagtgcagtagcgcgatcttggctcactgcaacctccgcctcccgggttcaagcgattctcctgcctcagcctctcaagtagctggaatagcaggtgcacgccaccacattcggctgatttttgtatttttagtagagacgggatttcaccatgttagccaggctggtcttgaactcttgacctcaagcgatccatccgcctcggcctcacaaagtgctgggattacaggcgtgagccaccgtgcccggccaaatttcaggccaacacctgttgacacacattgccagacacacggaatccctcactgaacaccgatgggcccacaaaacacgcggaggccacggtggctgaagatgttagcaaattcggttcgcggtgtctggggtacagcctcgagggtccattggctacctctgtgcaaggaccactctgcgcaaggaccagtcaccgctgctctcctcatctccattgagattctcccgcacacacctcccctttctttgggccgctgaggcctcttggacctccgaggtgattgccccgcccgcagcttctctccttccgggagcttcatttcttgttcctctccgtagtggctcagcggtaagcccaaggtccagcacacgaatcaggaaactgatggttcttgggtttgcaggaatccgcccagagaacagatgaaagtaacaggtaccaatatcaaaactgcagtgactcaccagaaacactacgtgcttgccactttgcttagcggtttgttgagtccaacaactgcgtgggtcccgggttagtctcctgaatgtcttttgctgctactttggtcagcgttgttgtcagtttaccttgtggtggccaagcccttaaatgcactattaggttatgcagtgtaattctgcagggcagaagggtaaagagccatagtgaagagcaaaagaacctcttgccttgaccgggaattgaacccgggtgtcccgcgtgtgaggcgagaattctaccactgaaccaccagtgcctctccccagcaacccttggagaattatcggaaagagtatccagaaagacttagaaacttccaagcggccttttcaagtgtcgactcaaagctaacaaagacatccaaaccaaatgtttttataggaaacttttactaaacaaagttataaatatcaaaatagctcatttgtcggatcaaactcttaactctgaaaaaggtctttctacctgcattacatacccctataataaaacgtcacaaattcattcatgtttcttttttctaatcctaaatcttcaattgtcaacgtcaaactgctgccttagtggttctgagaaggtaacctaactggtagcttaggtaagtaaagttctaatccagggaggaaataagaagcagaagcagaattagaattagaggaaagaggaaataaaaggacagaatcaaggtagagataatgaagaaacaaaggttggtccactgagttagtcttttgtcgctggtttttttggcaaaagagtaatgatcggtcttgtaaccataatactgttatttgtctgcttgaagatgtataaagcatttaaaggaaatgtgatataaaaagattaataatgcctgcagtcaatatttcattgttagagagaatccaatttcctaagttaatatgctttgatgtattagctatgtaaggagtagactagtttaaggaaatattgatggtcaaaatattaacatattagtcttttgatgaagttcaaatagagagatttcttttctcaattttccctggagagattaaactgaagagaaaaattcagagagcttgccccacatgttgggtctgtgagtcattatgactttttcaaagacaggagctgtgacatggaatcatgcttcttctctagctgagaagccaagctaggtccaggctgggtcataaacttgagcccaacaaggaaatcacccttcacattgacctcacagagctttgactgttctctgttctttgcccaacacccaagacacacaccagctctggccaacaaaccttaacatattatctatatcaaccagagctacatttattcccaaatctccttctaaaatacaaacctgtactttctactctcaacttctaaatttacaaaggcctcatatgcatctcagagtcacagatgctaaaactcaacacaccggtgagttccctgtcagcaatatgtaccaccctctacctcaaaacccaatgatcagactcaagcacagcatctcccaaagagtagtgcactgccctgggtgtttcaatgatcactaaaacctgtttctagccctgcctagcacacttatcctcaccaccatctatcctatttgccaagccagatctttctttggataaactctctcattttcataacacaacaatttcagttcaattcaaaaaaaatagcgtttaagtttattggatactccacaagcttactgccactttattaccacacttttccatctatcggctcttgcatccattaacataagcagacaaaaaactggactcctggccaggtgcggtggctcaagcctgtaaccccagcactttggaaggccaaggcaggcggatcacgaagtcagaagattgagaccatcctgactaacatggtgaaaccccatctctactaaaactacaaaaaaaaaaaaattagccaggcgtggtggcacccatctgtagtcccagctactcgagaggctgaagcaggagaatcgcttgaacccaggaggcagaggttgcaatgagccaagaccacacaactgcactccagcctgggtgaaaaagcaagactccacctcaaaaaaaaaaacaacaacaacaacaacaacaaaaaactggactccctacagccagtgtagtatgcaccactcacttgccacactgtatgctgagtgacccttccacagcttaaatctgcacataacttcagcctagaaccatataatgtccctttatttcttcagtacaatgattaataccatattctctgtacccttcttcactctatgctcatcattctaacagctcttgccaatactcaaatccaggagcagcaaactacttcacatgtcacaaacttttcacaggttcacaccagtggattccccagtgaaccagctgtcttaactcaggcttccataacaaaataccacagactgggtggcttaaacacgaggaatttctttctcacagtttgagaggctgagaagtccaagatcaaactgccagcggattcacctccttggtgagggctctctccctggcttgcagactgctacattctccttctgtcctcgcatggtggagagaaagagagcactttcgtctttcttctgtttcttataatgacactgatctcatcatggagatcccatggtcatgacctcatctaaacctgattacctcccaaaggccctacctccaaaataccttcacattgggggttaaggcttcaatatataatatgaagggaacacaaacatccattccattacactagcacctgcatttgcaatccagcctctgggccaggcttagcagtgtagagcccaaggcttcaattgacaggatttttatgctctcatgctctggctccttggctccagaagcttctagaaccagtagggtgatacatcctttagcaactatattgtaaaacacatggtgggtaaaagagtgccctattaagtattttggttatgcccccattagtgtgcttggctcaatatattaatagtaagtagtggttcgcatccaccctcagtaccgccctctgcagtcatcctgtcagtttccattccattctcctatccctggcttgctggttcaatactcttaagtgatttactgctggtgctcttctttttccctcagagataccttgtgatttctttgattctctccatctctacaggttaataagtctaatatttaaaaactctgtagagggatgttgggaagctgtggggagagcccttgggcttttcgcctgggtaaagtgcagattcctgagaattctgggccttggcttccagctgcactagtgccggccactcagctgttctcagcagcgtcacctggcgcaatggtgctgaagcgcactgccgagaggccagaaggcaaagcgagagtcggtggctatggcctggaacccatttaggcaaaacagagggcgcgcggggacaaagcaatagagaagggtgggcaatacaggatctgtacaccatacattagcaattgtatttattaaattgttgattacctaagcctccggagagtagtttggacgcttaccggttttctgaggattatttggggaaggggtatgcatgcaaatgtatgtacataattcgtgtgatttcggaatattgactccatgagttccagatgcagatttggaacgtttttaaaaaacattttgtttttgttgtctcgcaaatcagccagatctgcaactgtatcagagtaaagcgaagccaagctggacccttaggaaatgcgctaacatgtcatccactttcggtgtctgcctgtgaaaattcaggcgataaagagaatgaagagaaccttaaggaattgctggaaccaaagttaatattaagcaggcctgctgtgacgtcctcttcctggcagaccagtggaaattgtagcctggtcgacaatctgtatagattgatgaggtctaaaatgtagtcacaggttcaactacttttctgttttccaacctcgagtaaactcactaaatttaagggctaacaaaaaaaaaaaaacaaaacaaaacaaaaaaaacctctgtttccgcccagtttcgaaccggggacctttcgcgtgtgaggcgaacgtgataaccactacactacggaaaccacacgcggaacctgcgcggcaaaacataaccatgaaaatcttagatcagccgtttctattatagtttccaaatctaagatcgcaccactgcactccagcctagacaacagagcgagagtctcaaaaaaaagttaggagaagaaggtgccattttccctagttgcttttcttactgcggtggtgaccgcattgccttcacacctgaagtccaagtgtttgcaccctggggaatatgcagacagctgggtcactggacgccaggccgcagcgccggcctcgttctgcttttggctctaaatgcagtcgggggacgcgactggatctcaccagagactggtgggctgttacccttaccagcgactggagggccaacctcccaaagaggcctacttcatgatcgccttaaatcaggaaatttcatgaaatcccacccctctaccgccccattcccatattgtatctcctcccctgcccactctgagaggattcgccccctttctgtctcgtctggaccctttggagtcccacatagacaagacaaaaggggcattgccttttcctacaggagcgggaagagccgtcacagcggaggaaacagagactcacagcgcgcatccccacatacttgcgccctgccgagttccagcaaacccaacaaagcactctgaagcttctctggaaaaggaaggagtgtgaggtttctgatacggcaagaggagccaaagagaggggacccaggccttcccctagctcgagagaacaaacccagaagaagggcagatccgaaggaaaagcgcaaaggcggcccaaccccacgacctgagcgagccaagggtcgcgggttaaattgcgtttatcagaacaattgtttgctcactgtcccaaagccctcctagggacaaagaaaacactggcatggcaccagtcgcagaagggggcagcattgacacccaggaacaggcgtggaaaagcaggaaaagcagggatcatctctctcctaccccgtatatggctgcagacatagcagtggttcttttctccaggacccagtgagtgtgcaccaggagagaacattatgcacgttattcatggtggcaccacccaggctgaaagtgagcctgtgctgcttgggctttcaggaaggacgggcccaactctccctccctatacagagctgcagtgccctggcaatggaggacagaccatggagttgcctgccctggactcggggaagaggctttgccctaaaccccattttagtggtagctgtcagagtgccatatccacagacttcagctgcaccacagccaggaaccaaaggacaaagtctttataaaatgaaggttgtgagctctgtgacagggcatgatagggaagcggatcacattcttgcctactcaggaggaggagctagtgcacctctgccccttcccctgagacctcagcacaccccgacatgatctctttcccaccatcctgtcagggcaggtttttccactggacaccagcctacgtaacagccctgactcttaagcaccatctactggactgcatcctaaactggaccactgaattcaaaaaccctgctaccaaagggcttagtgctagtccatgagataagtttcctgagaattccgtaccctcagcccccaacaagggttagtgtgttagcttttacttccaatacatcaccacaacaagcagcatctgagaaagctactgctcagaagctatccacaaccaagaaacccatacaaagctagggctccctgaaagcacccagaaatgaagccaaacaatcatacacaacatacaccacagtcataccatcaagggaaaaaaagaataaaaacattaaaaatcctcatccaaacaataccaaattcaaaactaagaagcaacagcttcctcggatgagaaagaatcagtgcaataactccagtgtacccagagtatttacacacttccaaaggatcacactagtttctagcaatggatcctagccagactgaaatgtcggaaatgacagataagaattccaaatacggattgcaagggaactcaatgagatccaagaaaaagttgaagtccaatgcaaagaaatcagaaaaacaatacagaatatgaaagacaagaaaactatattaagaaaaatacaaatagaacttctataattgaaaaattcactaaaggaatttcaaaatacattgaaagctttaataatagactagacaagcagaagaatgaatttcagagcttgaaggttggtctttcaaattcacctagtcagacaaaagtaaagaaaaatgaatttttaaaaatgaacaaagcttttgagaattatggggttatgtaaagcgatcaaacctatgacttattggcattcctgagagagaagaagaaaagtaagcaacctggaaaacatatttgaaggaataattcaggaaagaattttcctaacctttcaagagagattgatattcagatacaagaaattcggacaacttctgcaagatactatacaagataaccagtgaaaagcatacagtcatcagacttcccaagataaatgtgaaagaaaaaatcttaaaggcagctgaagaaaagggccagattatctataaaggaaatcccatcagactaacagcaaacttttcaaaggaaatcttacaagtcagaagaaactggggcctatttttagccacctaaaagaaaaaaaaaactgcctgtcaaagtttcatactctgccaatttaagcttcataaatgaaggagaaatagtttttcccagacagagaaatgctaagggaattcattaacaccagatagtctctataataaatgttcaaaggagttctaaatatggatggtacttgctaccataaaagcacatgtaattacaaagctcgtacaccttataaagcaatatataattgggtctacaaagcaactagcttaacactatgacagaaataacacctcacacatgaatattaaccttgaatgtaaatggcctgaaagttccacttaacgggcatagagtagtccaggtgtggtggctcacacttgtaatccctgcagtttgggaggccaaggtgggtggatcacttgaggtcaggagttcgaaaccagcctggccaacatggtgaaacttcatctccactaaaatacaaaaattagctgggcgtggtggtgggcgcctgtaatgccagctactcgggaagctgaggcaggagaatcacttgaacccaggaagcagaggctgcagtgagccaagatcgcaccactgaactcagcctgggactccatcaaaaaaaaaaaaaaaaggcatagggtggcaaattgggaaaaaaaaaaatcaaactttccatggcctttaagagagacctatcttacatgttatagcccccaggggctcaaagtaaagtgatagagatctgttatgcaaatggaaaacaagaaaggtcaggagttgctattcttgtatcaagtaaaacagactaaaccaacaagagttaaaaaaagaaaaaagacaaagaagggcattacataatcagaaagcattcaattcaacaagaagatttaactatcctaaatatatatgcacctaacattgaagcacccaaatttataaaacaaatacaactacacctaagcaaagaaatagacagccatgctatactagtggaggacttcaacatcccactgacagcactagacagatcactgaggcagaaacctaacaaggaaactttggacttcaattggactcttgaccaaatgaacctaatagatgtctatagaatactctatccaacaaccacagaatatacattgttctcatctgtgcacagaacattctctaagattgaccacatactcagtcataaagcaagtctcaataaattttttaaaaaatgaaattatatcaagtatcttctcagacaacagtagaataaaagcagaaatcaatgccaagaggaactctcaaaaccacacaaatacatggaaactaaacaacagaatcatttttgggtaaacaataaaattaaggcagaaataaaaaaaaattgaaacaaatgaaagtagagacacaatgtgccaaaaactctggaatatagaaaagcagtgttaagaggaaagtttatagcactcaatacctaccttgaaaagatagaaagatctcaaattaacaacataataccacacctaaagaactaggaaaagaagaagaaacaaaacccaaagctaggagaaggaaagaaataactaagatcagagcagaactaaatgaaacagagataaaaaaaaaaatacaaaggatcaatgaaatgaaaagttggttatttgaatgattgatagaccactagctagattaaccaggaaaaaaagatccaaataagcacaatcagaaattacaaaggtgacattacaactcatatcacagaaatacaaaagatcctcagagactactatgagcatctctacatgcacaaactagaaaaacctagaagaaatagttaaattcctggaagcacacagcttcttaagattgaaccaggaagaaattgaaatcctgaacagaccaataatgagttatgtaattgaatcagtaataaaaattctactaatctgaaagagccctggaccagagagaattttacagctgaattccaccagacgtgcaaagaagagctggtaccaatcttactaaaactattccaaaaaattggggatgagggattcctaactcattctatgaaaccagtatcatcctgataccaaaatctggcagggacacaataaaaaaagaaaactacaggccaatatccctgatgaacacagatgcaaaaactctcaacaaaatactagcaaactgaatccagcagcacatcaaaaagataattcatcatgatcatgtgggctttattcctaggatgcaaggatggttcaacagacgcaaaaaaaaaaatgctattcactgcataaacagaattaaaaacaaaaaccatactattatcccaatagatgcagaaaaagcattcaataaaatgttacatccgttgcatgatacacaccttcaacaaaccaggcatcaaaggaacataactcaaaataataagagccatctatgacaaacccatagccaatatcatactgaataggcaaaagttggaagcattccccctaataactggaacaagacaaggatgtccactctcaccactcctattcaacacagtactggaaatcctggccagagtaatcagtcaggagaaataaaagcaatccaaataggaaaaagggaagtcaaattatctctgttcaccaaagacatgatcctccatctagaaacctctaaagattcctccaaaatactcctagacttgaaaaacaagttcagtaaagtttcgggttacaacatgagcatacaaaaatcagtcgcatttctatacactaaaaatgctcaagctgacagccaagtcaagaacttaatcccatttaaaatagccacacacacacacacacacacacacacacacacacaaataaacaaaacacctaggaatatatttaaccaaggaggtgaaagatctctactgggagaactacaaaacactgatgaaagaaataatagacaacacaaacaaatgggaaaacattccatgcttgtggactggaagaatcaatattgttaaaatgaccattctatccaaagcaatctaaagattcaacgcaattcctatcaagttaccaatgtcattttttacagaatttaaaaaaaaaattataaaattcttatggggctggacattgtggctcatacctgtaatcccagcactttgggaggctgaggcaggaggatcacttgaggtcaggagttcaagggcagcctggccaatacggtgaaaccccatctctaccaaaacacacaaaagttagcaggcgtggtagcacacacctatagtcccagctaattcaagaggctgaggtgggagaatcacttgaacccagaggcagaggttgaagtgagccgagatcatgccactacactctagcctgggtgacagagtgagaccctgtctcaaaaaaaaaaaaaaaaaaatccccatggaaccaaaaaacggcccaaatagtcaagcaatccaaagcaaaaagaacaaatccagaggcatcacattacctaacttcaaactatactacaaggctatagcaacaaaaacagcaaggtaccgacacaaaaatagacacatgaatcaatggataagaatagagaacccagaaataaagtcacacacctacaaccaactgatctttaacaaagttgacaaaaataaacaatgaggaaaatgataccctatttaataaatggtgctgggaaaactggctagccaaatgcagaagaatgaaactggacccctacctcccaccatatacaaaaattaattcagatggtttacagacttaaatataggacgtcaaactataaaaatgctagaagaaaacctaggaaaacctcttcttgacattggcctatgactaagacctcaaaagcaaatgcaacaaaaacgaaaattgacaaatgggacttaaacttaaaaagcttctgcacagcaaaagaaataatcaacagagtaaacagacaacctacagaatgggagaaaatatttgaaaactatgcacctgacaaaggactaatatccagactctataaggaacttaaatcaacaagacaaaaccaaataaccctatttaaaaaatgggcaaaggacatggctagacacttatcaaaagaacacatacaagcggccaacaaacatatgaaaaaatgcacatcactaatcatcagagaaatgcaaattaaaactacagtgagatatcatctcacagtagtcagaatggctatattccaggctcgaggcaagcgtgctcttcacgagttctgtcattctcttgagtgaagctcacctggtatggtaagttgtcctcattttaaaacattcagattttattctgcaatcctttcacatgtgacagtttttctgttcttcctaagcatgtaatggaagtcaaggaattctacatcctcactatctattaatatttcttaccttcccacagcagtgaaattcccattctagtcttctgaaacagagatagctaataaagaaaactcatttctcctttaagcttttccacacatttcagaccattctggttttattcttttctacacaaattttactctttataggtgttcaataaataaatataaacactaattttaaaaataatttattaatttgatctcttcatttaaagataatatccaatgcctccaagttcccacccaagaattctgttggatagggctggaaaagttctggagaacattcttccagactctctaggcatcatgtcacaggatgtcctcaccacagccagaagagtgactctgagtatatgaatgaggggctacagtggactgtgcagtacctagggagggagagacagggctgcaatgaagtctggagggatttaggagattcattgattgtaccaaacaaaaacttaatttcttctctcctattccgtacccaggtgaaagtgggaaagacaggaagagagacaccaagctttctagttgacagctagtgactctctgattatctgcaaagattgggaaaggaacttaaacatgacatgtagattttccagagatatttactcctggagccaggagtctgcgaacatgtaggtgggatcttttaagaagcagccttatctagattgggaataagctattatagttttaggctgtgtggatctggtcaacttttgtgctgcctacttctctttgcttctacaactgggcatcgctgcagaaaggaagaaatatggaagtgacttcagctttgattttttccttctggaagcctgaaaactccagtttgcttccctgagcccttttcctgttgcacaactagggtgtggactacaggtcctacccatggaagatggaggtagatacttcacagggaataaaaacaacccagacaagtcatacctttaggtaacagatactttcaaagatgtactttcctgcacccattaaagttttagtctcagctaatctgaaaacctgcggtcctcctgcactgggatagcagtgcaatatggctcaggctcaggttttgctgggcacaccagagtaggccacacactctcatgtgaagtggcttcaggtatggatcagggtctttcccactaattggcttcagttatgatgttgtaggtcatcattcttctggctttaatacgagagaagaagggatggggaagaactggtctccaagtgagagcatccagggtgaagagtgtggaaataagggtcattagcacaagagaagagccaggtgatatcaaaggcatgtagtaatggcataaaggtggaacgttgctctcattctgctgaagtgggcaccatggaaaccttggtgctaccactcgccagtcaggccacaagcccaagaacagcaccaggcagtataaggacatataagaatgacatcacttcagatagtcctgagaattagacctatccctgcttggggcaaaccactcagtgggagcaatagtacccttctgcttccctatctgggctaattgtaaggaacaagtgaaatcatgcacaccaatgtgctttaaaccggtaaaactctgccccaagaagctatgtgcccttttgagactccctagacgtggacagaaacataaaatttctgcctttctaccttttccttggtcaccattgctaagcacatgctgcagcctctccctcaggcggtcattgagactgatggactcctccaggcgctggcgcaggttctgtatctcagcaagattcttttccagcaggtcggcccctactgcaaacaccaagacataggagaggtaggaggtagggaagcctgatcatccctgggcagctgtggggcctgcgtggcatctctctgcaagatccctacctatctctatccttctgtcagcttcttcctctctcctgggcattcaggaagcaccaggcaactttacttaaaagtcctgggctttcaatcacagggtggccccctgtaaggaaacaccacaggcctcctcccagacagagaccaccaagtacatctaagggagatggacacagggtgagaaactgctaaaggcctctaggcagaactggcctagtaatgggaaaggctgtctacctccttggtatggaaaacaatccagagaatctccctctctacctcatccctctccccgatgatgatcccgactcaacagcctttgagatttcactcactcacagacagaaagaccaaggtaagtgcatatgaaattaaaccaggctgtgaataatgagtgatagtgaatgttctcctttaaccagttttggcaaagaggaacatggaagagcttgggaaggtatcaggatctgaagtgggggaacaggagagaagggaacaatctccaaggaaggaaaaagatgcacagagagaggaggctgagaataggcttcacccactgggagattttgcgtagggtcaggcttttctctgagaatttaaaatgtcttattgttacactacctgggacacagaaatggagctgcttcaagccattcctctaaatagctgcactcctagctgccgggtgccaggatgtttggttccaaatccaaaagcaatatttatgggggcaggattggcacgtggttgtatgcacagtgtgtgtgaaagatgtgtgtgaaagagtggaaagagtgtgtagggctgggtgactctgtagaaatagtttcccatccgacagtagctcctgacctaaggaagaccttccccatggaaatctgagcttagcattccaggacagtcttaatctaggcctaagaaggttgtagcacagagagaaggcaacatttaagtgtgaggtaacttatcctccttgtagagcacctcagaatgtccctgacttctcctactctcctgcccagagtgagttcctaggtagggtggctaggagaaggcactttcaaagaacaagcactgagctggttctcactgtctggctgatctacatattgtcctgtcattttttatgaaccaggttctaacagaggaaccaaaaaatcctctggccaggaaaggaatgtgtcattcctaccaatgggctcgatttcactaagtgctcctttgtgttttaccagaggtttcggagttgggttggtacaaagaggagaaggaggctaggtctccagatgcattcattttttgaggcctcatctcttcccatgggccactgctaccgtgttctagtgtcctgctctgctgggccagtgccgctcgaaggatggaagggctgggcagacctggttccttggttgctgggcaaagcagctgaatcagcagaaatggcagggctggcatctgtccagaaaggaatgtgagtgagaaaccaacagggaagtcataaaagagtattttaaaggtaattatagtgagttgaatagtgtcctccaaaaattcattcagttcacttggaacttcagaatgtgatcttatttgtaaatggggtttttgtagatataataagttaagatgagatgatactgaattgggggtatgtcttaaatccaacatgactgatgtccttatgagaggagaggagacacagagataaagagacacacagagaaggagaccatgtaacaagagaggcagagattggggtgatgtgtctacaacccagaaaccaccagaaactaggaagaggcaaggaaggatccttccctggagtcttcagagggagcatggccctgctgactccctgattttagacgtcttcatctccagaactgtgagagaatacatttctgttttaagacgcccggtttgtgtttttttgttttggaagcccttgaaagctaataaagcaatccacggaatgaagactaaggcagatgtcagcagactcatttcccaaggacttcccatttcaccctaaagtaactggcatttctcagcctatgacataagcagtagtgttagttgtaatatctgagcatcacagcgcacatacaggaaaaatatggggcccctctcctagctccctttatgattcccaatgctggaatgatcctggggaggtacttcagaaatgtttctcctaatagcaggactcacagccaatcctaggagttcagacagtgaggggtgaagcattttgttggtctgtaaacaggtgactatttattcaacattctatgcccttgctagaaacacaccagctactccttcctgggattgttctacactgaggctgttggaggaggaggagaaaatggcctccacttctggacaatgtgcagagaacctagagagtgttgcttccactcctggtggttctctctctggcctcggctgactctggacctgcagtgaagctgagggggtgtctgtctaaggcaagtggtgatttggattccacctagaatggcttttgacactgcaaaaataattcttatgtacagctcacattgtctggctcctgtccatagaatagctagtgtactcttgcatagaggattgtagaatcacaaaatacatggcatcttacagctcaatgatgccatgagaacatggccagatcctctgggcccttcattactgtctccctttgagagaaaaaccaagctggggtggcagggccataattcagagaaaagttttagagtctttccctttcgaggattattatcaagggctaaagaatagacaagtttctcctctgagcaggtgggagtgaggtttctgtttgccctcaacaacatcacgttcttttaggaactgtatatttaaatcagtatccagtaggtctctccttctccaatttataaaatatcagatactaattagaatcactgtgagataaagagtaacgacaactatgttaagtctttaataaatgcctgacttaaagtaggaactcaatcaaaatgtgattaccaccccctttcaaacctcctttatctcagaaaatcagtttactctcaaccatggccataggaagctctaagttttatcagtaacagtgatcagtgttttaacgttccctggccataccacaaggggaacatgccctacactgcagatggaaagcaacagagactagacttttgtgaaggaaatttggcctcacaatgtagctgtcatgccagtgcactacaggttgactgttctagaaattttggttcaaaaaccaaagaggaagtggtgataaacagttgcccctgtgaaaggacagtgacttcaagtgggaaagagaagggcttcgatctccctcaggaaagacagttgtggcaaaaagtaaagctggtgctctccagaagcatcattccagaggccacacctcactgcaggcagtggcagggattgcaggtaagggaagcatgggcttgcccttctgccatctcttggggcagtgctgaggttgaaacaagtgcctctgggcaactgaatcaaggatgcacataaaagtcccattggccccttggaataggtgatgtacatatcaagggcagctcatctatttacaaattcttagatagaagtgtaatatgtgtaaggtcttgtcccatcttcagaggccagaactctgctgggtgcacagagcagaaaaagtggaatgagaaaaaccctggctccagaagcctagcaaaagaggtgctgagaaggagtgagcaccctttgtgtgcagcccctgacttctcaggctgcagagtgaaatgctcacaacctgagctttgagtcaggtagactcaaagtgtatgttaccccaagctgctttgtcttcagtaagttccttaactttgctgagcctcagtgtcctccactataaaagcagaacaccactacctatttgaggggatcactgtgtcaattaaatgaggaaatatatgtatagtggtcaatattgtgagcataataggtgctcaatcaatgagaagttcctgtctttccttggctgctataatcttagaggaaacattttgccgctttgctcctcattgtgaaatgagaaacaggaatagtaccagatcaaaacccattatgggccgggcatggtggctcatgcctgtaagcccagcactttgggaggctgaggcagttggatcacctgaggtcaggagtttgagaccagcctggccaacacggtcaaaccccatctctactaaaaatataaaaattagcctggcgtggtggcaagcacctgtaatcccagctacttgggaggctgaggtaggagaatcacttgaacccgggaggcagaggttgcagtaagctgagattgtgccactgcactctagtctgggcgacaacagcaaaactccgtctcaaaaacaacaacaacaactaaaaaccattatggctcactcattacttaaaattgccaatttagaaaaaaacaccagatacagccagggactaaaaataatttcttggtattgtccacattaggatatgattcatactggcctaaaacttcaaacacttttctcaagaggaaaattaaagagaaaactgagcaggagaaaaatgaaagtctggtttaaaacttaatctcttcccgtctctatcaaggctatcccaaggaccctctcagggaaattctcaggagggacacgctggttggtgatggactcagcttgaacctcacagcatggccccattcactgatagtttagagggtgttacagcaaacttattaggatgatggatgggatctgtaaatgcataaatgataaagatgatttagtgatgaacaaaaaataggaactgtggctgtttaccccagggattccaggattaggtgcacaatgttagcaacactcatgtccctagtttgaaagatgacataattgtgtgcagtgaagaggaactatttgccccctttctccccttcccaacccatgccccccaagaccaacaccatgtatgtgccagaggggatctagtgactgatgacatgtgagactgggaatggagaaaagctacctgaaaaccttggggcttatgctcagcactgagtcctggagctgtgcccgaccagctacatcacagtggatctacagggcccggctgcaaagatgccacctcttggcctagacaatgcatgagccccaaaaactggagccatgtggctactcactgactacagtcactgaaggatgcacttcctccttgtcaagctgtggagacgtgctgctcagggagtgatgtgggctagaccgggtgtggttgctgcaccagatctggggctgagtctgggaccgggcatcccacttggtctctaggacttctgtcactttactcatattatgcatcttcctcaagatactagtggggtaagaaagaagaaaaaataaaggtcacctaatgccacagctgtactaatctggaggctcacaggagatgtaaaggggaggtcaagaggatcattccttcagaggagaagccaaacaaatcatttctgtttcaggatagagtatggagggaaggcggggacagagagagcaacagttgtctggtgcattggctacaaacatcctgaggaaaaacgaagccataatgggccccttaaataacactcatgattccttcacaaaacagccagagacccataagagttcaactccaggtatgggtatggcggtacatgcctgtaatcccagcaatttgggaggccaaggcaggagaattgcttgagtccaggaattcaagaccaaactgagaaacatagtgagaccctctgtctacaaaaaataaaaataaaaaatgagctgggtgtggtggtgtgcacctgtagtcccaactatttaggaggctgaggaggatcacttgagcccaggaggtcaaggatgcagtgagcagtgatcgtgccactgcattccagcctgggcaacagagcaagacctcatctcaaaaataaaattttaaaaatgttaaaaaaaaaagaattcaactcattctgtgaacataatttttaaaatagtatttgctataggccatttaaaacagattccccaggcaatgtagcctcactggtgtcttgcagtttctagatctccttccctaagtatagagacacagtataaacttttgtttgcaaggaaaatttgtagctgttttacatcttccagcactccttgggtcacccttgaagaaatcagatataatcttactctggtctttaaataagggaaaccagaggtgatccctggaggttcagaagactcctaagacccagataggttagagcagctctatgttactaaattggtgaattaattggtgaaaataaaagaataatatattttttaaaaaattttaaaaatgagactgccttatccctaaggatacataatggtttaatggataaataagctatttgttttttactggccatgtatgctcctgtttctttgagcttctggctcttgcttctggatccttcaccagattacatcttcgacagcccctgaaaatttggagttacctgagagtcgaagacacctgtcctacttgattcttcttacttgtacagtcatctgagaacaaaattcaaaaaggccagtcatgctttaagcaggtctcatttcccagactgcaaacaaacatggaggtctatctgggagcagagacttgactacctgatgcttgccttgattccaggatactctgaattttctcagatcttgggttgagtctttagagagcttgcctggcaggctttcctgagcccaccatgaaggtcatcatctccacttgctttgccctgagtcacagcaaaaagctaaaaatgtctttattcccacatatcatggaacacatatccactccagccaaagcctccaagtcctggcacaaggccagcacccaaacccatggctgtgtgttccaccatagctttcatgcagaacttcctcccttctccaaggagatgatagacatccgtgtcccacctaccatcaggagacagcacagtgaactcaagccttctgctactatgggcccttgggttctcaagggggaatttcatgtaaaatgctcctgaaacagctaattatctcaccaccgtgtactagtacacacagtgcctgaaccatgccaaagtcagcatgattctttatcatttttttgaagtgcgccgattaatgttacttatttaatccctagaacaatcatgcaacattcaagggctggaattatttgacttaattttttaggtagagaaacagaaatcaaaataaatattaacctgtccagagctggtaaggaacacatataagctagaggtagggtttttggattcccagttcagggcccttcacaaaaaccagctgcccctgctccttctgtctttctgccaattagtttcagatgaataccatcatccctggggatgcctcctgccctaacagtcatattccatgagggatggaggtgctggtgatcatcatggcatcctcaacccttcttcttggagctcctctccagccagtcctgactctgtcatggtcataaggtggtgattacaaagcaggacaccaggttgaaaagtgacatgtgaatgggggtgggatcctgtgaacttaggaccttgggagagactgaaaatcttcctaagctctgcggccaacttacctgtgctgaattttctggcaaggctctctgccagctggcttcctttggccagctgcttgcagtagtgctgctccatatagtggtcaatgttattgctctggagtagctcctcaaaggtctttagtgtgttcttgacatgctggatgagaagaacagaggccactctcccaagcttcatcttctgccgtaggtgggttaactcttgagcctgatcctgaatcaaggaatgatacttcctaaagtagaaaaaaagaagtaaaggtagataggaataactgataggttatagcaatttaggagaaggaacttgagagtatcaccaaaggaggccacacactgaattctagcatatgtttagtgtcctgaatatggtaaaaggaatgaaggaaatgaaaacaatctttatgtgaaagatcccttctaagattgtcattttccctgccacttgctaaagaagaaaaatcacttgatcatattaatagatgaagaaaaagcatttgacaaaattcaacactcattcatcataaaaactctcaacaaagtgggaatagaggagaccttcctcaacttgataaagaacatctataaaaactctacactaatgtcatactagaaactagaagctttctcactaacatcaacaataaggcaagaatttccccgcttaccacttcttttcaccatcatactggaaatcctagctaatgcagtaagataagcaaaggaaataaacggtatacagattagaaaagatgaactaaaactgtctttgttcacacatgatgcagttattgtattatagaaaatctccaacatggtgaaaccctgtctttacaaaaaatacaaaaattagccgggcgtggtggcatgcgcttgtaatccagctacttgggaggctgaggaaggagaattgcttgaatccgggaagcaaaggttgcagtgagatgacatcgtgccactctgcactccaccctgagtgacaaagtgagacactgactcaaaaaaaaaaaaaaaaaaaaaaaaaaggccgggcgcggtggctcatgcccgtaactccagcacttagggaggtcgaggtgggcggatcatgaggtcaggagatcgagaccatcctggctaacacagcgaaaccccgtctctactaaaaaaacaaaatagtagccaggctactcaggaggctgaggcaggagaatggcttgaacccaggaggcggagcttgcagtgagccgagattgagccactacactccaacctgggcgacacagtgagactccatctcaaaaacaaaaagaaaagaaaagaaaatctgaaagaattgacaacaaaaatctcctggaactagtaagtgattatgtcaaggtaaaatctaacaaaacatgtacaagatctgtatgaggaaaactgcaaaactctgttgagagagatcaaagaagcactaaatacacagagagatattctgtgttcatggacaggaagactaaatattgtcaagatgtcagttcttcccaacttgatctaaagattcaatgcaataccaatcaaaatctcagcaaataaattttgtgaatatcaactaacagatgctaaggtgtacatagagaggcaaaagacccagaatggccaacacaatattgaaaaggaacagagggctgatatgacctgacttcaagacttactgtaaagctacagtaatcaggacagtataagatttgtgaaagaatagacaaataagtcagcggaacagaatagagattccagaagactccaaaatatagcagattgatctttgacaaggggacaagggcaatacaatggagaaaagatagtattttcaaaaaatggtgctggaacagcgggacatccacatgcaaaaaaagtgaatctagacacagacttcacattcttcatgaaaacttactcaaaatggatcataggcctaaatgtaaaacataaaatgataaaaaaaaaaaaaccctaaaagataacaacagctgaaaatctagatgaccttgggtttggtgatgactttttatttattttatttattgatctaaagattcaatgcaataccaattttaatttagagacagagtctctaaataaattaattattttatttatttgttggagggcatgatcatggctcactgaagcattccttgggcgtgatcatggtgtgattatggctcactgcagccaaactcttgggctcaagtgatcctcttgcctcagccttccaaagtgctgggattacaggtgtgagccaccgagcccagctatatgattacttttcagatataacacaaaaggcatgatccacaaaagaaataattgataatctggacttcattaaaattaaaaacttctgctctgcaaaaggcacatcaagagaatgagaagacaacacactgggagaaaatatttgcaaaagacatatctggtaaaggactattaagccaaatacacaaagaactcttaaactcaacaataagaaaatgaaccacacaataaaaaatgggcaaaaaaccctgaacagacacctcaccaaagatgatggcaaataagaatatgaaaagatgctcaacatcatatgtcattagggaattgcaaattaaaacaacaagataccactctacacctattagaatggcaaaatccagaacactgataacaccaaatgctggtaaggatgtggaacaacagatattctcattccttgccggtgggaatgcaaaatagtacagccactttggaagacagtttggcattttcttgtgaaactaaacatactcttaccaaatgacctaaccatctgctcctcagtattttcccaagcgagctgaaaacttaagttcacacaaaaacctgcacatgatgtttatagcagctctattcataactgcaaaaacttggaagcaaccaagatgtccttcagtaggtgaatggataaattttggtacatgcagtcaatggaatattatttggtactaaaaagaaatgagttatgaagccatgaaaagacatgaaagaaccttaagtgtgtaagtgaaagaagccaacctaaaaaagctacatactgtatgactctgactatatgacactatggaataggtaaaacagtggagacagtaaaaagatcagtggttgccaggtgttaggagggaaaggagaatgaataggcagagcacagagaatttttagggcagggaatagtcattctttattacaatggtggatacatgccattatacatttatacttgtgtcaaaacctatagaatatacaccaccaagaatgaaccccactgtaaactgtggactttgggtgatgatgagtcaatgtaggttcatcagttgtaccaaatgttatcactcgggggcaagatgttgatagtgagggaggctgtgtccgtgcaggggtagggggcatatgggaactctctgttactttccactcaattttgctgtgaacttaaagctgctcttaaaaagtccattaaaaaaaagaatgatcacagaagtataatttttaaaaatatatttgatgaagtgggtgtagtgtagcctttgtgaatcgagagcacaggattccaatgttatctctgccagaggctattatgcaactttgatcaaatgactatctcttagggcctaagtgttctcagttctaaaatgaggtaatgagactaactgactctagagttttttgggtgttttgttttgttttgttttgttttgttttgttttgttttgtctgagatggaatcttgctctgtcatccaggctgaagtgcagtggcgctatcttggctcactgcaatctccacctcccgggttcaagcaattctcctgcctcagcctcccaagtagctgggattacaggtgcccaccaccatgcccagctaatttttgtatttttagtagagacggggtttcaccatgttggccaggctgtctccaattcctgacctcaagtgatctgcccacctcagcctcccaaagtgctgagattacaggcgtgagccactgcgcctggcctagcgttattttagccctaactaacattattctctgggtcagtgaaatttaagtggaatatattgggcagtgacctaatggagcatgaagcaggatttgaatcacttccaaagctgtgcaccaaccacttaggcaaattagtgatttcagtaacttagtatttcagtaactggcgctcacaggcaaatgcgtaatggattaaccccatattatttaaatgcttccaaaaagctataggaaaatggccatgaaaaacaaactgacaaatttagccaacaggccactatttgacaattctgcaagcttatttttaaaattcagcttatcaaaactgccattccagaagccagggacctgagtttccatagaggatggagtagaatggaggggcctctgtataaatctacctcctcgggaactgggacagttcagcattcaccagagtaacatatgaagaaacaggagattcctacatgctcctggggatccagaagagagaccactcacatgactggaagatttccagctcaggtaaccacaaaggccatatatttggtgaatacatgcaatgttagttagaataaaaccaaatttctctgaataatataaagtcattactaataaaacttttatagatttttctctgaagaaatttccaggaaggtgttaagagaaaaccctacaattaaggtatggaggctggctgcaggccctgaaagctactctgacgagcaatgacttaatgctgatagtgggaagtctcttgcccactgcaggatacagagaattcttcctcaacccgaggcttctgctcattcactcccttctcagcaggtcccttcttctctgagggctgatgcatcccagccttctgctgggacattttctcatgaagagctctcttacagccgtctttgaaaggaaggacagagaagaaagatgtctatgtcttcacaatggccaggcttttctccaaaactacctaaagcaattgaaacaaaattatggcttacagaggttagattattagtggagatcctgtaggacgatagaatctcaagagcagagcctaccaggaagtagagtgaagcctacaacttcctcagccatgaggacccaacaatccactgggtaaaagaaagatgcagcaagtgctggggtggggtcggggtgggtgctgttatgagaaggaaggggaggtcccacaggtgtttagaagaaaaaacaggcaataaatgaatgaaaacaaatggggtttaaactaagctaagggatgagtatttttgtttcttatagctgagataaggttcttatgaagttcccagggaatgtcccttcagaggtcaggaagcattttgcttccacaagttttgagagtcatgaaggcaggaacacattttcagatgccagagctcaaatcccatgtcactgggacatcaacaatagtgctatggggaagactcagggtgccagctcttgagtcacaatcacagaattagaatgtggaagtagctacagaacccaaggaagccctgccttctgatagccacactcaatgcaaggctgcgtatttcaccctggaggtctctataacaggggaggccaccccctcaatagccagcttttttacccttttgcttatgttgtcaaccaatttctaaccacagcaaaataacctaagtatacctctccttgaaaacatcaaaacactttctcagcagcttttactttcttgaagacaatttcagtaaaaacaattcttgtggcttttcctaaatgattttttttttaacttctagtgattcttactcttcgtttttaggaactctccaggttttcacttcctacattctttcaagagtatagtgactaaaactggagaataatcatttaagtctgactaataaatttagcctcatgttgtattaccttttaatacataataaataatatatcccaatgcgatacttgcttcctttcccttgcagtagcaacgtgtaggggtttcatttaatatgaggtcgattttaaccttccaaactcccattccacccacctttgcttgcactcatgggaaggctcagtctatatctggtttgcccacattcctaggctatagacctctaggactcccaatttgagaggcgccatttttttggagggtagtgaattttgatttctgtctcctttgcatccttcccaatgaaaactgctttcagccactctctgctagcctctcaccagcacagagctgaattcacaaatgccttgaggggaaaacctttaccaagtgttcagttcacatctcaattcattctagaatcttggcttttcaagtcaaaatacctggacagctccacatgtctacccactccccacccccatgaggttacttaaagtgctgctgttttctctggtttttaaccactgccctctccccagcttctcagcctcttgtcccttgccaagaactagcaaataccctgagggggaaaaattgtttcattccaatgatcttctttctctctctctctctccacccgctttctgtagctggccctgtgggtcctagcttttcaaagacttcaaacagaattcctttaaaccagattttatctacttcttttcgaagggagtgctggtttgccacaaaactccatcgtaactgaaagaggaaatcttctacaaattccaggtaaatcaaattttcctaccttgatttctgaagaaaacaaaaaaaaagagaagaggccattggtaggtatatacttgcatttttcttgtaatacttgcgtaagtctgaatgggtattaaaggctcttgctagaatcatgtgccaaagattgtctaccatgacctaaacaatcaggcctgtccaaggtccaagaatttgatcaggttggatccagtcctctggtgcactaacagagatcctgttggaggatagaatcctgctgtaggattctacgtctgtactttgagtagacacttcaagtaaccagtttttcagacacctggccactaatatggggagaagaggtcaaaaaaaccattgaatatttctaatttattttagggaatgttaaaatttctcactggtacagttagaaatgaaaacaaagacataataataatagtaataataataataactgtttcaagagcattattatgtgactggcattgtttctaagtgctttactgtgtagtaacctatttagtccacataacgaccctacaagatagtgttgatttttttgtttggtggttgttgttgttgttgttgttgttgttgttgtttgagatggagtctctctctgtcatccaggctggagtgcagtggtgtgatctcagctcactgcaacctctgcctcccgggttcaagcgattctcctgcctcagcctcctgaacagctggatcacaggccccacaaccatgcccagctaattattgcatttttagtagaggcagggtggtttcaccatgtcagtcaggctggtctcaaactcccgatctcaggtgatccacctaccttggcctcccaaagtgctggaattccaggctgagccaccccgcgcagccgatagtgttgattattacaaccccttgttgcagatgagaacattgcactgaaaggctgagcttacctttccaaggtcccatcatctctatgagagtgagagccaggactcatccagacccttgctctgagccattaggcttggtggtaactaagaagatctcactaagatgcgcattccctccttcttgctcaatctccaagatttcgaggacaaaatggaaattaaaagtaaggcctacaagatggctattattttaaaaagaaggaaagaaaattatcagtgttggtgatgatgtggaaaaattgaaacccctgtgcactgttgtttggaatgtattaggttggtgcaaaagtaactgcggtttttgtcattacttttaatggcaaaaatcgcaattacttttgcaccaacctaataaaatggtacagccactgtggaaacccatatggtggttcctcaaaatattaaaaataattatcacatgatccaacaaatttacttctggctatatactcaaaagaactgaaagcaaggattcaaagagatatttgtgcacctacatcaatagcagtattacaatagctaaagaagggaaacaacccaagtgtccaacaacaggtaaatgaataaacaaaatgtggcaaatacatgcaatggaatattattcagccttaaaaaagaaaagaaattctgacacatgctacaacatagatgaacatgaggatattatgcaaaatgaaataaaccagtcacaaaaggaaaaaatactatataattctgcttatatgaagtatctagagtagtcaaattcatagagacaggaaataatggtggttgtgccaggggctagggagggaagaatgggaaattaatgggtatagcgtttaggaactttagtctaagaaagtagaatattggatgccagaaattcagttttctttctgttccaagatccctttagctagagcgacatattgaagtcagagttcctaagggaaaatcattgtgcatggagatcatccttgtggatcaaatgtgaatcaatagtagatcaaaagatattccacttttgcagatattgacatttgttggacccgtaagattttatctagtattagatagataagatgtgaaccacttctcaacactgcagactcaaatactaggaaatactaagaacctcaggacaaacaaatagccagtccaaaaagactcacagactagataagctgtcatctaccacctaacagataatgtatccctgttaaccactatccccagatgttcatttcataaaatcaaaaacagaattccatgtggatcatggaaaaaaatggttgacaatgtacaaatgagagagagaaaaaatacttgtctaagaattacatttagtgtctaaaagccaaatagctcaatttctgctcatgagattcaacagatgaactgagggaacatatgccaatagctctgagattacaggtccgcatgggatgcccataagatgcaggattctattagctaagattatatgtctcaggtgggcaaatctttgtggacatagcaagaaaaaagaaaaactgtcaaggaataatatagagacagtgtgatggttaattttatgtgttaacttggctagaccacagtgcccaggtatgtggtcaaatataattctggaggtttctgagaaagggtattttggatgagagtaacatttgcattagtagactttgagtagagcaggttgccccatgtcatgtgggtggacctcatccaatcagttgaaggcctgaatggaatgagattgaccttcctggaagaagaggaaattctaccaacagaatatcttaggactcaaataacaactcttccctgggtctccagcctgcctgccttgaactttcacaatcatgtgagctaattccttaaaataaatcaataaaaatagatgatagatggatgattctgtttctctggagaaccttgactaatacagatagcatactaattcacccttgccatttatagaggaaagagtggagtaataaatatcagaatatcttctccagacctggtcaccacagaaacaaattatagctatgcaaaatatcttggaagtttagctgaagagatgaggagatactctactgctccatgtgcgccatgtcatctgttgtacctccccttagttaagtcaggagggcaacactccctttattttttattttatttcgtatgtatgtgtgtgtgagatggagtctcgctctgtggcccaggctggagtacagtggcgtgatcttggctcactgcaaccctgcttcccaggttcaagtgattcttgtgcttcagcctcccgagtagctaagattacaggcacaggccaccacctgtggtaatttttgtgtttttagtagagatggggcttcgctattttggccaggctggtctcgaactcctgacctcaggtgatccgcccacctcggccttccaaagtgctgggattacaggtgtgagccacagctctcagcccctctatttatcagacagatgtatagaaagtttattgtgctagcaagagtatgaagaaaaggattctctgagttgaaaaaacaaattggaatataaattggtaccacttctatggaaggcaaatttacagagcttattaattaaaataaaaaatgtgtactgtaaccactatgatacagcagttgcgcttccagaactctaccctatagaaatccgtgtacaaatagcaaaagatatttgtacaagaatgatgactgcagcattatttgtaatcgtaaaatcatggaacaaacttaatttaaaaaacaacatgtaaagggttagatgatggaataaacaaaagaagaaatgccttcatcaaaaataatgcagaggataataataatcttgagtctactgataacattattgattgagcaattattaaatctaggcacatcctgcaaatgcggtattattaccatcctcatattacagttgaaaaaatattgaggtacaaatagcttgtcaatagcccaaaggcacaaagagaagcaagatttcacccagaacccgtgaacagatcacacaaaatttctcttgttccctggtccaaggaacttctgtaccttccaactgcatttctttccaacagagaccttcttggaggatgagaagcagccactagttgacaggaggggaagtgaggcatgtagtcttcaagggagcagaccaccgtgggagttataaaagatcagcgacgcctctgggtgtgttcgaaccaccaactttttagttaacagccaaacgcgctagccgattgcgccacagagacatggctgagctcctgatttcgttctaaaagagggtaagctgtcactaaacgctagctagcaccatccgccttttgcaaaatgactgggtaatctccaaagcctcggaaagccggagcagtcagagcgacgaatctacttgtttgtcaagcttgaaacctgtgcactgagtgattccgaaacgccccgcaccccgccttgccccctcacctgcctcagaagccggcgcttccggagatgccgggatcgcgactcctgttagagcgacttgggccccagggaagctgaaacgcccagggtgctcaattaggacttgttgaattaataatacatttcagagacagaatatacaatcgaacaatggccggactgtacgtaaaaatataactctgatccacaacctggggccacctgcccaagaaatcaacttccttatctacgaataaacaaccggggaagccagcctgctattacataagtcagactcacagggagccaggcagttatctgtagtaacaaacaataacatccataataatcggctccaaatggcaagagcttggttagtaactgacactttccctaatttatgttcccacttgcaacttaggaccaaccagggaaagccaaatatgcacccctaaccaagcacactggatgtcccccttctagttagcccacaggcagcttccccacaccagcagtctccaatcagggcacacctgaagccttccctttcctcagctataaagctgtcccactcctctacctgccttctaagctctgtcaaaatgcaagtgccggtggctgatgccggtggctgtcgcccttgcgtcagaataaataaccattgcttttttcatttgatgggccttcgttttcacactttgtcatctttaagcttttagccctttgaaggattctgagactggaaaataaatgaaaggatttttcaaagggggaagttctttttttaaaggctttattctggtcaattgatttccaagtgtgcaatgtcccatggggtaggccacaaagaggcctagagtgcgccatctgtgcggctgcagctcctggctctcaacagaactgagatctaagtcctcatgatctgatcagcttccgagggcctaaacctcctattaccaccaacttggggattaggagttcaacaaataaatttggtgaggggacgcagacacacaaacattcagaccatagcaatgcataaaggtagctcatcactgaagttttaatttgtgtttccctaacgagtaatgattttgaacatttttcttacgtcttttggggtcagtgggcaagatcaggaaaggggcagggaccaaaggagacatgaagagggaaacagcagggacaatgacacctcccaggagacttgtgcagaggcaaaggctggatcctgagagatgagaattgtttttgtcatgtatttgaatgggaagaaatagaaaaaggacatgaaagagaaaaaacacaagaacttgtagctatccaagaacaaaacaggaaaatatcgtggatattttttcatcaaaaatattaaaagcagcccactggcaaccccaggtttatggtgcaccatgatgatataatagttagtgctcttcattgtgaccgaagcaaccttggctggaattggagccacagtagcatctggcttccttcttggcaagatttggtatgtgttacagtttcactttttaaatccccttaccaactgcacccagtagctgtggtcagaaagcagagtttactgtgtctccctgtgacgcagtcaggacaagagaaggaaacccccacagtgcactaacctacggcagaatctttggggaaggttagaagggaccgtgtgtctgagcatgtgcaggaaccatctcaaaaggtaaagccctgactcttcaggagccttgtctgtagcttcaactgacataatggtgtggtaataaccatttttctggctgagatatttcaaaggtcagtaaggcctttttagatgcaatgacaatgagctttgtatgagttctcattcaacagggtattttacaataaaatctgatcatataaaacccaataaatgtaatagaacctaaacttgatgccatcctccacctcccccacctaattatttggcgggggaacgggagcgctaatagtacattattgaagtataattcacatagagtaacatgcacaaatcttaagggcatagaaacgtaaccatcgcctagatcaagttatagaaaatttccatcagcccagaaaggtcaataacctcctttagattcccatccaccttcctttcacttagacaaaccattctgatttctatcttcacagacgaatgttgactgcttctgaaattcacataaatgaatatacttttttgtgtctgacttctaatttcctgcagcataatgtttttgagatgcatccatgtttttagtatattattttggtgttattgatgactgttatttctgtgtggatgactgggttatttccaattctggctctcgtgaacaaagctgctatattctagtacaattctttctgtagacatatgcacccatttttcttcagtttatacctggaagtggagttgctaggtcatggagtaggtctaaatttaactttattataaactgccaaacagttgtccaaaatggttgtgctattttacctcctcaccagcaacgagagtatagttactccacattcttgtcagtacttcttgtctttcaaatttcttctattcaagctgttaaaataccttaaactgagtagcttacaaacaacagaaatttatttctcacagttctagaggctgggaaatccaagttcaaggtgccagcagactctgtgcctgatgagggctcactctctggttcataggctgtaccttctccatgtgtcctcacatggtggaagggcaaacaagctccctccagcctcttttataaagatactaatcctatgcatgaaggcagagtcctcatgatctgatcagcttccaagggcctaaacctcctattaccaccaacttggggattaggagttcaacaaataaatttagttgggggaggcagacacacaaacattcagaccatagcagtgcataaaggtagctcatcactgaagttttaatttgtgtttccctaacgagtaatgattttgaacattttttcttatgtcttttggccatttagaaattttgtgtgtgtgaagaaagcctattcatgtattttgctcatttttaaatagcttggcttttattattaatgtctaaaagttctctctaaatattcaatatttgagttatttttcaaataagcatactgcaaatatcttctcccagccttaacaaggcttgccttctttcttgtggtaattttttgataagcagtttttaattttgatgaaatccaattttcttattttttgtgacctctaagacatctttcctaccctatgattgtgaatatattttcctacattttcttccagaaacatgtttttatttttatttttaaatctataattcttcttaatttcatctcctgatctcagcacaatgcttaaccactataaaatccacaacttgcagaccaacagttcaatctcccagaaacttgtataacccttgatgtaacatttacagtagtttcctgctgtgctctttgacaactatagatccttgcgcttccaccccactgcccccttgccttctcccttctctctcctcttttcacccctacaaggtgagaaaaccagaaagacctaaaactgaggagaagaaagacctggtctaatctgtgctcaagatattagagcacaagaagaagaaagactgggtctgatctgtgctcaaaccacacctgtattctggtttgtaagtctagttctgcccctgtgtggccttggataaataacttaaactttatgtgcctcaatctttcttctgtaaaatggggctaataagagtagtcttaggccaggcgcggtggctcatgcctataatcccagcactttgggaggccgaggcaggcagatcacttgaagtcaggagttcaagatgagcctgaccaacatggtgaaaccccatctctactaaaagtaccaaaattagctaggcatggtggcaggcacctgtaatctcagctactcaggaagctgaggcaggagaattgcttgaacctgggaggtggaggttgcagtgagctgagatcacaccactgcactccagcctgggcaacagagcaagactccatctcaaaaaaaaaaaaaaagaaagaaaaaaaaaaagaaaagaaaaaagtagtctatttcagtttgccattgttagctgtgtctggatatggttgacgattaattagtaatcaatcagaatgatcttcctcattgtcattttcctctgcattatttttgaaagcaactatgctgatgttttgcatcttaaattagtttttcttctaagaattccagtagatggactcatggagtatgcccactgttatgtccagttccttctttctgcataaagtctctgagttttattcacattgttgagtatatcagatgttcattcctttttattgctgagtagtattccattgaacgaatataccacagtttatttgccagtgtcctgataatagacacttagattgtttgtagttttgggtatgtgaataaaactgctatgaacgttcttgttataatgtgtgtgtgtgtgtgtgtgtatgtgtatgtgtgtacatatgttttaaagtctcttggaagaatatctaggtgaagaattgctaggaaaaaaatgtttatgtttaaatgtataggagactgtcaaaccaaagtgattataacattttacattccctctaaaaatgtatgagttctgggtgttccacatcttcaccaagatttggtggtttctgactttataattttgccatgctaaaatggcggagtggtatctcaatcttgtttaagtctatttctctcacaactaatgatattgagcactcttttatgaactgactggccactagtatattttcttctctgaaatgtctgtttaagcttttgcccatttttaaaaatgggtgtaggagctaattgtatactctggatacaggttcttggtcaaatatgtgttgtgaatattttctcctcgtccatggcttgccttttcagttacttaatggtgtctttggatgaaaagacatatttcatatcaacaaagcctaatttatcatttttctgttttatttatttctctgtgtaatatttagaaaatatttgctttctgccaagtcttaaagacattttcatgcattttcttctaaaacttcatagtttgtatggtttgttctgtgatccaactcaaattagcttttgtgtatgttgtgaggtagggattgagatttttttcctcactagtagatatctagttggtccagcactactcgttgaaatgacacttcttccccattgtattactttagtaccttttttgaaaaaaaaatcaattgaccatataacaaggatctgttttaggtgtctcacttcagtttcatttatcaatatgtgtatccttttgccacattcacactgttttgtttatagtaataaacagcttaatagtaagtcctctaggtttgacacctcaataaacctgaaatgtgtacatcctatggtgccaccatgaaaatcaagacatgctgtcacttaatctctctcatttcactagaggacacatgctctcataaataatggttgaccccttagccaaagatcctctattgtaccctctggagaaaataaatctctagttaccttaagagctgatctagaggtaaaatgtctgcaacattcagcaatgaatttagattttctttgaaaaaaagttcattttcaaggtagttttttttgttttgttttgttttgttttttttgccaaagaatttcttttttttctgttacttagtagcgtgaagtacaatgtttggtttgcaatttctgttctttgtaggaagaaaaactttagtggaaacaaccagtacttaaagaccattttatgaggctgtcatttacatattatctcttttgctgtttttgttaaaatgatataaggtgggctttatatgctttctgtataacctttggaatgtgtatttaaattaaaaacgtaaaattaaaatattcatcctagactcaggttaagttccaccaacagtacacttaaaataggatgagcccaacctaagcgtacaacctacctgcttcaagtgtgtagttggtgtgtgtgatacattctcaacagtatttgtgttccctggtgtagtgattttcgtgttactcccacccttgaaagtcctcgacttaaaacccatctagaacatttcctttgctaagactttaaagtattctttcttcaagttaagggtagtttttaaatagttatcagttgcattcttggaattcacagaaagcttggggagaaacaatccgacggcacaagttcaagtgcccaacggggtggagaagggactgcatactcactggttgccaggccgaggttgtccgccttgcctgctttggctgagactggagacggaaactccattcaacagcgactggaggactgaaacggcgcaagagggcggctgcccttcacctactggtccctccctgccttggcgccttcggagttcggactgacccgggatgttgctggagccggcaggaactgcaaactcaccgcgcgcgtccctgcacacccgcacctgcgcctcgagaactcctggccagttgaatacccggtctgccgccgagcttcgctgcaggtcacaggaaaggggtgcagggttgcgtacccggcgggggaagccgcgcggagaggaccaggtgctgctactggcctccgagaagacaggcctagagtagctgattttgacctgcagggccaaagtctaacggcggcctaaaaccctaacgtctgggcgagccgcgggtagcgagttgaagcgatctctatgccttgcttgtcgtttgccaaaattcagaccaagaaagagaatagttgtgtggatcaaagtctgcaattaaccaaaaaagaaacatgatcctgtgttagcttacttaggaaaaaaggaagaaggaaggaaagaaggaaggaagggaggaaaggttggagggagggaagaaagatgaaaaaatcaaccaaaaaaagaacataatttcctaactaatcggatgtgggtcatgagagaaagacctgcgtccagtttttggcctgaacgtgtggagggtggagttgccattaactaacgtgagaaaaggcaggtgtagtacgttgtagagaaaatatccggaattccgttcagggccctggggtcttccttgaaagagttttccatccaggccgtctcggtttccgcatccgtctgagtcgtttatgatgtcgggaatgcaggaatctgagtcctttatgatgttgagggtgccacggtctcaccccgggcgcctccccgctccagcctcctcccggaagcctggtgcgctctggccccgccgaccagcgacagtctctccacgcgctgccgcctagcaaaggagcatctttaggtcggtagtgaggtgcggccgggacgctgcaactcgctccgggacttgtaaacctggcaggtgttcgaggagcgccactggctggaaggaaaggagagagctctgcacgtcgcgtgtgggctcgcaacttggagaaagcagggagaggacagccttttgggactattccttggatgggcgggtggcaccaggaagggtagatggagctttctagaggtcaatgtcagcgtactttctgctgaaacaattgaaggaggaaaaaaaaaaagtatgtgctttgtggttccctggtagtctagtggctaaagtttggcgctctcaccgccgggactggttgattccagatcaggggactgggtctcggcctcactgtgaggtattgttctttcctgtgtttgccatctaccaccgctgtggctcaattatttcaagactgctggagaaatggaattaatgtcgatcctaacatttaagctatttatctaggataaattccaaatagtggaactgctaggtgaaatttattgtgaatttaagattccgatgtatacagccctacaacgtataagcaccaattacattccccaaagtgtgtgagactgcgtcttttccccagaatttaaaaccaatgctagaaattatcagacttttagagataattttaagcttatttatcatcaaaggatttcttcatagtcaatttccccttagactataaatccgcaagagatggcaaagctggaagaactgcctagaatttcagcaaacttgaattcaatagtctctctgttctttcctgttttggcacctacccttttcttccagttaagattggacacaatagaaaaataattaataaatgtaataaaaatgtaagcctggacgttttgctcacagtgttctcactgggtctaaattttgtgaatgtggttccttggatggtctcatgggtatgcttgagactttaggcccttgggacacctggtgcacagaagggtcccaaaacccatctttggaagtgttggcagagtaaataggcaccagtaataaaggcaacggcgcctgaatacgtaaggctggtttaaaccaaagcagatttttcaaaaccagagagggcttgtgttcataatttaataatttaatttttattttgatgaaatttaaatttgatttaaattttcataatttaattttcattttgatggccactttattttgacaaagacactagtggaggaaagtctctttatcggatcatcaatttccctataaatctttgtctcagaaaaatttaataataatttcataataaattataataaataatgtttcacatcttacattattcacttttgatttagttggcttgtgctgtcaatatgttgcccactgtataacactacctgatgaattacattcaactatgtagtaatacatattactacatatacacacacacgtatacatgtgtatatacatatgcatatacacacacacatgtatacgtgtgtgtgtatatatgtatatataaccatatataatttcaaaaggtaaattaaatataatgggacagtgttggtaacctcttagatagtgtagggataagatagctgaatttatggcatggtgttgtatacttcagatatctatgctgtaatattaaaatggcatttccttggcccactaaattgtccacttcctggcccaatatgatacacgaaaggaatgaaaatgggaagaaaatagccttctgaaggacttgcctaataaacttctcccttagcattacttggagtgacatcagaaaattggaatgaagtaattgtgtaaaaaagacaaattctctgctgtctttctcccccaatccttaataaacaaaggaggaaacctagactcaggttaggttttctcttcttattctttacataccaggacaagtactgagcttgtttgttactatatggggacttagtgtattgtacaaaggggtgtggctattactgtcccttttctaccagagcatcaaaactggtaacttggctggtgttaaggggagcttctaaccttgaattcccactccatgtgacttctttctggttctctcttctcagagaacttgcagccatcagattcatttggagaagtttgataaaggtgactttacgcttagacagaagaaaaaaccctaaggtcttgaactaagccttatcctctgatacagtttactggaattccctccactgtggcacaagccctgccataaattgtgattatctataccttgtcagttttatctgtgtatatatcttttacagtaatccccacatccaccagagaacctaggttattggcagaatgaggtttgggaattttggtcctctggccagacactatcagatagtactctgattccaccatttttgaaattatatacaacaaattttaagtattgtttattttggagagttcaggttaaaggaaatgaagactattattcagtattatttctgtaattttgtaattttaaccataacataggtttcttatcaaaatgtatggaagccagaaagcagtgaagcaacaatattttctccaaaacaaacaggccaaactttggcaggagtgacaaatctggcatgcaatggtggcttctatatcagaaatcaagtcttttactttgtgagaggcaggagtttttagttctttgtcttccttttggctgccagaggaattgaacattgtgaattcattggcatagtcccaagaaactttacttggcaagcaagctattgattttggcgggggtgggatggtgtttatcagtcacccctactagcagagatgtgataacactgcagtcagagtagttgagttttaaaattttgacttgccaaccaacagaacattatttatatggtaaaacttagacatcagaggctacaggcactcaggctaaattctgacccattcattggtgacaaatgttaagggatttttgtcccattagccctttttttactcatgatggtactctgaacagaagaatctcctctaacaatttaagaccattcattgtataagcatgtaaatcatcaatctcaatgacacattttcacaactatacactgaattggctcagaggcttcactcataactttaactttttttccccctttactacaagttttacccaaactctgtcagttgaattcacactctacaggaacacatatcaagaagtttaacacatgcactttagttacagcagcacctgccaggagaatatcttacctccttgactgagagttcaaggagtgcagggagatgtgaccagccatcaagaagcagtagagagacttctttccttaaagtacctgagtcaggttgaggggaagagaagaattaggagcacaaagagagcaggcacacaacagaaagcacaactctgcaattgcttttggttttaagaggctgtccattcagtttttttttttttttttttttttttgagacggagtctcgctctgtcgcccaggctggagtgcagtggcgggatctcggctcactgcaagctccgccccccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccattcagttttttgtttttttttttttttcctttttttgaaacggagttgcccaggctggagtgcagtggcatgatctcagctcactataacctccacctcctgggttcaagcaattctcctgcctcagcctcccgagtagctgagattacaggctcctgccaccatgcctggctattttttctatttttagtagagatgaggtttaaccatgttggccaagctggtctcgaacccctgacctcaggttatccacctgcctcggcctcccaaaatgctaggattacaggcatgagccaccatgcccagcctgtccattcagtttcaatgaactttaaacaacaaaaaatgccatttgggtggctggtttcagtcttccctgtcaatgctcagcctccaaatattcactaacacacagaacaataggaggactgttactctcctctcacacctactacgtgggagagaacatctgctaccagatcctggaggcccttctcaagccccctaacctggccccatgtggttctttctgttttttctcctagaaggcattgtgaccttactggtcccatgttgggcatcaaatctgtgaatggctcacacttggacttacgcacacagcataagtaataggggatatctatgcataagaaagattagtatgttgtcagctccccacatccataattccacagcatgacaccaaactggagttactagatgacaacccaagtggtgggttgctctgtcaagaaggggccaattttatattgcagctaggcagttacagtctgtagctgtaccattgaggggatcggggcaagatggaaatttccatggtttaccagaaacaggtgagaaactgcctgctggtagcctgctgcaagacaaggaggcccccaaaagagatgagtaagaaatagtattatgataatgcctcacaagactacttcccttaccatggtccaggagggcatttggtcaaggtttgagtcatagtatggttgagccttacctatgtaaagtttaagcaaagccattcccttgtaccttgtaccttgaagagagtttcattggatataatatccttaatttgcactttcttctttttaatgagtaaattgcattttattttattttattttattttattttattttattttattttattttattttttgagatggagtctcactctgtcgcccaggctggagtgcaatggcactatctcggctcactgcaagctccacctcccaggttcacgccattctcctgcctcagcctccggagtagctgggactacaggcacccgccaccatgcctggctaattttttgtatttttagtagagacggggtttcaccatgttagccaggatggtctcgatctcctgacctcatgatccacccaaggagtctctctccctccttgtgttctggtctgtgaatggctcacacttgaacttactgtaggctcctagtgggaggagcgggggtggcgaaaatcctcatcatatggataaacataacccaaacctctagaggtttcataattttcctcttgcttctaaaaacatagtcatgtcttatggggtgttatgtactttatatcttaacattttccacttgctgcttcttggtttgaggggagaaatgccagcatgtggcaaatggagaataagactgatggaagcctcagggcaaggccttcacttcccagtgacactgttcccaattccctccagcatgagctgagcctcctcaggctgtggttgtgcagcagacagggtgtgaggaaaccctgctcagccctggttacccaggatggcactgagttctaaaacgcaaaggttatgtggtgaggggcctggctgaagacctggtgtggtacttttgtgagcagtggcaccatttgaggctgggtaggagagaggtgcagggcctagctccccaaaagaccaacagataaactggggcagagagagagattccagtgtaaccgggaaggctgcagatcataacaactatggctgctgatttggcatcaaagatgtggcattgtcaaagccacaattgttgagaatggcaccaacatgctgcagctggagagagtgggtgaccaacattttgaagtggcatagttgtctggggtaattacccaaggtttgttgcctcacaccaagggaactgaggatgtggacacacaagaagtgggtttaggagtggaggtttactaggcaaaagaaagagaaaggaaaatagctctctctcctgagagagagagggttgccagagtggaacttctggttttgtggtgaagtgcacagggttttataggctggcttgaggaggcagtgtctgattcacatagggcccaaagattggttggaccaggtgtgacatttacatagcgctggaagaagttggccacccaaccctaatcttcttcttatgcaaatgggttttctactttactcatgccatgttgtctgctccttactgtacacgtggttagaaaggaaaagggaagatggagccaccatgttgaacatgcctatcccccaggtagccttgtcctattggcacagccgccagcagtcacctgtgcaagcttccagcttgcttatctatgtctgcagctccattttacaggctgctttttgttagaaaagaaattatttgggggctgcttttcattaaaagggaaccttaccaaggacttccttaccctaatgcctaaataatttctttttaactcctatatcaatttgtttgaagaacagatgacactttgaatggcccagcccacagcccagaatttcaagggaagaccttgaattcaagggagacaatgtctcccgtaaaatcacctaggcacttacatagcatatttttctgtccactgtcttgctagtctgttgtagttctctctgttggccttgtaggtgtggggtatctctagcaccagaggatcattgaggttggggatgcagggcagtgagcagatggacaagagaacttttgacagtcaatgctggagaccactgagaccataggatgtcgaagcagatgctgtcattgctattgatattggggtgataaattttggttgtgaaagcaaccttgggggcttgaacaggcaatccgtaggaaagtggatggtcaggaagaaaacacctccttggcaaggactgtcattaattatcacccagaggccccgtggagcactgggcaggaggattcatctgcaagttggttaattccttctggatccactttagtgccatcctaccccactgctgggggctggggtggcccagccacactgcactttctatatataagttttttgaaaatgctgcttcactgttaccttgccttgtatgttagtgcccatctaattcagttgctgttgtaacttgttccacagtgatgcctggagacctgagtatgttttatctttaaaatctaataattttactaggatattgtcttgaagttgatcatcctggtttaatttttgctgccactttatgggctctttcaatgtgcctcatcacataagtaatgtcattttcatttttgtaaatcaagtctcctagatcgttcacctgaaagcctgattctcctttagagaaaaaaatgctaaaaaacaaaacaaaacaacaacaaaaaaacaaaacattatatatcgcattacaattttattcaacaaatacagagatttccagaatagttaaaacaaagtagaaaacaactctggtgttataagagcagtaggttcatatgcccactgtgcagtaatagaccaatacactaagacagcagtttgcaacaaagaatttaatgatcacagggcagccaaggggagagatatgagtagaccctcaaatccatctcctcaagaacttctgcgttagggtttttaaggggattgtggagggtgaggggttggaaaattaaggttgttgattgggcaggggaagggggatgaaatcattaggatttggaaactgcatactgagtcagttcctcagtggggtccttcagaccagctgacatcagtagtttcactggtacacaggatctgaaagaatatctctaacgggaaacttaacatttcataatcttcaggttgttatctatagaacagttcaggagaactataatctagggcctgcctgattctagcacaaacagcaccaaacaactgtgaggaagcaggtccaagagcaggctgctctcaagagtaatgcaaaattgctgcaagcttgtttatttttgtttctccccttcccttcttccctgattaattttataaagtttatagggacagtttcaatggcttcaacacagtattgccaggtaaggacttgaacccaagaggcggaagttgcagtgagtcaagaccaagccactgctgcactgcccagtctcaaaaaataaaaataaaaaaaaaatcaggccaacacctgttgacacacattgctaggaatccctttgggaaagcaaatgggctcacggaacacacggaggccatggtgggtgacaatgttaactaattctgttcatggtgtccagggtacaggcctgagggtccactcgccacctctgcccaaagccacgtctccactgctcccctcatctccgcacggattcctccccacgtgcctccccttttcttggactgccgacacctgacaccaccaaggtgactgctcctccccacagcttctctccttcaggggacttcacttcttgttccttgctccatagtgaggcgtgacccagcggtcagcccaaggtctagcatgcgaatcagggacgtgatggttctttgggattctagggatctacctggaaaatagatgaaagtaacaaaagttttacataccaatattcaaaactgcatcaaactaccagaaacacttgccactttcaaagatagaccatgctaagtagctccaggtgtgtgccaccatgcctggcaaatttttgtatttttagtagagactgggtttcaccatgttggccaggctggtctcgaactcctgacctcaggtgatccacctgccttgacctgccaaagtgctgggattacaggaatggctcttgactctaactgcaaggtccctaaatcattagatcatttcctgaatatcttatgcttcaggcattggccatcacttgggttaccattgtcataagtcaaaagcctccacaaccaaggcccttaaacatgggatagcctgtgcagggcagaagtataaagaatatagagaagtgaagcacaaaacttgttgcattggccaggaattaaaccagggtctcctatgcaggcggtgagaattctaccactggaccaccaatccggctcttatgtgtggtcctggagaaacaattgaaatacaatactgaaaaagacagaaattgttccaaaagaagctttttgcagtattgactaaaagctaacagtagacatccaaaaccaaggtttttatagaatacttttactagacaaaactataaatattaaaatagcttatttgatcaaactttaattcctaaaaaggctccttccaactgcgtaacagactcctatagaaaaacatcagaaattcatccgggttccttgtttctgatcctaaatcttcaatttaggacctcaacctcaaactgttgctttagtggctctgggaagaaagcactaactggcagcataggtaagtaaagttttaatctagggaagaaataagaagcagaatcagaattagaattagaagaaagaggaaatatgctataccagaatatcataggcaaaaaaagaagatgaagaaagaggaaatgaaaggacagaagacaatgctaatggagttagttatttgtggctgttttttgtaaaagagtaatgatcagtcttgtaatcattataatactattatttgctttctaaaatgtctaaaatatttgaaggaatatatgatataaaaagatgaataatgcttgcagtcagtgtttcattgtttgggagaacccagtttcctcagttaatacattttcgtgtaatagctgtttaaggagtaacatggtttaaagacattttaatggctgaaatattaacatgttggtcttttgatgaagttcaaatagaggatttctttccccaattttccctggaaagattaaactgaagagaaaaatctggaaagtttgccccacctgttgggtctgggagtcattatgactttttcaacgacaggagttgtgtatgacatggaatcatgcttcttctctagttgagaagccaagctaggtccaggctgagtcataaacttgaacccaacaaggaaatcacccttcatattgaccttgcagagctttggctctatctgttctctgcccaacacccaagacacatactagttctggccaacaaaccttcacatattgtctgtgtcaaccagagctacatttattcccaaatctctttctaaaatacaaacctgtactttctactctcaaccccaaaatttacaagaggcctcatatgcatctcagagtcacagatgctaaaactcaacacaccagtgagatccctgtcagcatcatgtactaccctctacctcaatgatcagccccaagccagcatctcccaaagagtagtgtgttgtcgtgggtgtttcaacagatcactaaaacctgcttctaccgctgcctagacacctatcctcactgctatgcatcctgctcctcaaatcagatcttgatatcttctttaaacactcccaatctcccaacatgacaattcatttccaaagaattatagtatttaaatttattggactctatacagactcattcccactttgttactacgctggtccatccatcacctccattaacataagtagatcaaaaactggcctctctacagccagtcttgtctattccaacccatttgccacactgtgtcctgagtgacctttccacagtgtaaatctggacatacctgtagccttaaatcatatctaccaacatagtagccaagcaacagcaatctcttttcctttggtcattagagtcctagagaccaagaggatgttgggaaaagaattacaatggatcagctctcagaggcagtgggttctggactcgtgctggctttgatacgtgtacattggaaaagctcaagtacctggcaatacttggagattaggaagaaaggatgaaagtaaaccactgcactaaataacatgacaataatcacttatacaaaaattttaaagataaggaatatttaaagatttattagtttattatagctttatagttggagagtggagaagaaaataccaaagctttttgtcttaacaaaatggtgcagacagattaacatatattgtcacctatgataaccagtcagcataaaaagtatttagaaaggaatggttgtattctctaagagggatattctgatgtcatgttttttgctttagagtctattaatatagccacctttttgttaatgttttcagtcaagctccttttctcgcctttcatttccaacctttctctcactttctggtttagatacaactcctaaatatgtcatatagttaatttaaaaatccagtgtagcagtatttcgggggtttgttttactggataatttggtccacttacatttaatgtaattgttgatatatattaattttaaatctaccatctttattttttctgtttgttctgcttgttctgtttctatgtcttttcttgtctgttttggattggttatttttaactattataacattatatttttttacttttttatatgctttgcttcactttcttccttattgtatttcctttaattgtatttaagttgcttctattcttttgtggttactttaaaaattacaatcttaatctttaattttttttttttttttttgagacagagtctcactctgtctccaggctggagtactgtgccgcgatcttggctcacagcaacctctgcctctcgggttcaagtgattctcctgcctcagcctcccgagtagctgggactacaggtgcagctaatttttgtatttttttagtagagacagggcttcactgtgttggccaggatggtctccatctcttgacctcatgatccgcccaccttggcctcccaaagtgttgggattacaggcgtgagccaccgtgcccagctaatccttaatttattaaacatagtagtaattgataccgttatcctcttcctggacaatatatggatgttggaatacttttattccatttagtctcattctatatatatgctgttatcatttattaggtctaagtattaatagttttaaaccccagaagactagacatatattttatgtagttaatgttaatttagatttatcaacatatgtgctgctatcttgctctttatttctgctatgtctctgaatttccatatgtaatcatggtccttctgctggagaaacatcatttagaatttccttttgtgttggtctgcttgtgaaaaaactgtttcagctatttttctctgaaagtgtctttattttgctttaattagtggagattatttttactaagtatgtaattctggaggcagttattttctttcagcatattgaagatatttgcatttgattgtttctttcagaaggcagccaattgtctcgctgctgcttatttgaatgtaatgttcctttttttcctctgttttttgtctttactatttttgtctttttttttttttattgtctgcagttttactattctgtctttaggtatggagttccctttatttatcttctttgattggtaggccttctagaatctgttgacttttgagtttcattttgtctggaaaactctcaagtattatctcttcagttattgcctctattttctctctcttctacttttgagcctctaactaaaaataaaatagactttctcactctatttgttatatttttgtgtttgtgtattaaatattattttttctccttgttatatattctgaatttttttcttcttcctcatctgccattttactagttctcttttcagttgtgactgctctcctgttaaactcttccattgagctcttaattttgttttgttttgttttttccgaatttctatttgcctctctctaaatctattctgtcatttttttgttgtttccaattggtgtgtaaattgttaacaaaacccttttctccttctgcatgataatttgaccttaattaactttctagctctgtccacctagagccttctaatgacaaaatgtcaactatgttactaagcaaacattgcatatcataaaaaagactcctaactgatggactacacttggactgggaaaactaagtatctggaagaagccagactttgagcttctctgaatgcagtgactcctataacttgcatacacctggcatgggcattggaaactactctattaagttcttaacaagagataatggctccaggatggtgccacatgcacctcagctgtccccaagtagacaatgaggggtggagagtcaagagactatctcctaggtactgtgtggactgctgctgcagggactgctcctatagaaatatcatgcctgatgctgccctaatagcaagctataattcttatcctacatctctcggattaatctggtgccaagtatggcctctgagattcttgtgagcctgaacgttaagttgaagctaagaaaacatccaagtgggcaaaattcttccaaatttttgtttcatgaataatgtagacatcattgttttgcagtctttctaatatatctaatatttgggggcttgatttcaactgcctgacatgtctgctggttttcacacctggtttagtttctttgggttcattattatttttgagtatgtgccatatcttgtatctggaaaaatatttttggaataatctgagatctacaatgaaagctttcttgcccagcacctgggggtacttccagcccagaaccacctttaatcaagtaaaaggtgtgaaagatgctctgaacttaaactgtgtaacataagggatgtttcttttatagtccatttttatcccaagattatagaaatgtaaggttctaccttattgtaggattattctcctgataaactccccaacttgggcagactctggtcttctatttctgtcccattagtcacagaaggctgtcaaaccctaatatgcaggtcaggaaatgtccttagccaaaaaatggttcctctgcttgcttacggctctgggatccagtttttcctttacttcaggcctcgtaattcttcagtgttaatcatcatcttgatgcttttaaaaatatttgtttcctatatattacctaaatagcttagtcagtgttaccagaaatgtatcatcaacttttaaaatatactaaatgcttaaaaaaataaagtcatattttactgctatggctctgacttgaaactaagttgatgaggccatgagctggagcacaaatcagtccccccactgtgaaactgtcaggtcaccacaaatacagattttattagcaatgcagaatttttcttttccctcttaagtcatccagtgaccaatcggttctaggccacaagatcaaaaactccggtctcaaaatctaacaacccccagctggtaatctcacacatgctcagattttactttgtaaaagagaatcaagccacatcatataaaattaaacatttattatttttcttaatagtctaatagagatatacatttgtgtatattggccggaaattgggctaaaattttcacaaatggaaatcaagaatgttaccatagaactatcaatgccaactttaactatctgaatcagatggcatagcctagtttcctctacaactgacagcacactctttggtattttggtatttttcagtgtccttgaaatgtttaactacccactaaagaacaggtcacatggaattaataaacaaagggcttcagtttccatcaagcaccttcaagtgacaggaacagggatttaaataaaaggatctaagtcagcacaggaaagtgactgtgctgccaaagtgactcaaactcaaaaggacaggatgagacttactcagaacttcgaggaagtgtagagaaattatccaccactttttatcctagaggtgcctttgtggttgtgaccataccgtagaatgatttggggatcccttccaactggaaggacatcttagactgagggaacccaagaaacctgatttcggtcacccctgaccatcataaatcccatgcaacaggtccatgcattatctaatgttgactctgggaatggtcattgtcattgtttcctatttgaatggttgtcacatttcctgcttcaaatgatatccagaaatgatggcttgggaccatattctcaatttttaggtggcaaatagactccagagacatcacacataataaaatacttggactttgaaaggaaacagtcaagtctatgacttacaagcttataaagatccctcagatgagttatgtacatggattgagaatcagaaaaggaaggatgctctctcaggagatagaaaaaccagataaaaggagcaactgaaattatctgacccatcccctcatcgcctatgtagaagggaaatgctcactttatctaaccagtggataacagacagcctctttcattttggagctaccaaaaagaaaaataaattgtggtttggttcagttcccttttgaccagtatgttcttgaaattttgaaaacattttactctttttccttttagtgtttcagtgtggataatttcatttgatctattttcaagttcattttttaggccaaaatttgtcaaatattggcaatttcatatgattcaacttaatatattaacctaatgtgcaaaattcaaatttgtttctatactactaaataatatccccctgaaacgctttgccaatttactcctactgacagtgtatgaaaatatccattttatttcatcctttacaaggtgctattatcaataatttatacttttaccaatctgggaagtgaaaaagacatttaattgtcttgacttgcatctcccttattactggttagtttaaatttctattctccgttcatttttctgtttattttcttttgtagtacctactacttcttgatatctttgtttaagctttatatatttactttttacctgttaattgttgtaatcacccactaaagagtaaattctggctgggcacagtagctcacacctataatcccagcactttggaaggcccaggtgaatggatcacttgaggccaggagtttgagaccagcctggccaacatggtgaaaccccatctctactacaaataaaaaaattagccgggcatggtgatgcacacctgtgatcccagctacgcaggagactgagacacaataatcgcttgaaccagggaggcagaggttgcaataagccgagatcacaccactgcactccaacctgggcgaggaaaaagaaaaagaatcagttccatcagagcatggattaagtctcattcaccactctagtgcctagaacattttatgtactcaacatataatagttaaatgaatgaatgaaagttagactgtaggggtgtccatgaaagtagatattagctaagttcccagagattgactcctcttttcctggttctcacacttcaagctctgttaagcctggaggagggtgttttgtctttaaaaagatacagctccaggttacccctttggaccagttcctgttcttaggtctcagacttcctctattcatgaatggtggatatatatgatttcctgtgatgtttctttacattatgaccataatgagcgttgatttttagttcctgatcccctcatgtaatgactgttcaattaatgactttttgccataatggctattataaagctatgtcactttttggacaactccttttttattataatgatttgtcaccccaaaataaataaacatgctataagaaattatattttgacatcatggtttcaagcagacactatatagaaggatgtggccgggcacggtggctcacgcctgtaatcccagcactttgggaggccgaggtgggtggatcatgaggtcagaagatcgagaccatcctggctaacaaggtgaaaccccgtctctactaaaaatacaaaaaattagccgggcacggtggcgggcgcctgtagtcccagctactggggaggctgaggcaggagaatggcgtgaacccgggaagcggagcttgcagtgagccgagattgtgccactgcagtccgcagtccggcctgggcgacagagcgagactccgtctcaaaaaaaaaaaaaagaaggatgtgtatgaatgagcaagtagggaagtggccaaagaggggcccaccctctgtaatctgctttttgatgctaaggtgaggactctgcaaaccacatcttttttttgcttgctggctttattagtttctgtcagtaaggggtgttaaaaagagactgaaaggctggaggagggatataggtctggctgcttcctattttgtttcttgtttcaattagcatcatcccagccataattttttactctgagagtggtcattgtttccagtttcatttcttttcttttcttacaatcccggagcctcatggccccctctcaaaggcatgagcatcagccagtggacatctcttcttcagaggtctgagtccctgctacactaggtacttcctctgagttccaaggccagcagcaacctccttctcagaagccatcctcccagttatgtgtggcccttcatccaagttaccaagttctaacaacccaaccattttacctttgtttctacaaccctagggttgatcactgcttcgctttctacactaactatctctgtgttacatcagttccccttttgccttcttagacctccaatacctgtataattccttgtgttaaattccctctggtatactgttcattttctattttttttttttttttttgagacagggtcttgctctgttacccagactcaagtgctgtggtgcaatcatagctcactgaagccttaaactcctgggctcaagtgagtgtgccaccatgcccagctaatttttattttttttagacacagtgtctcactctttttcccaggctaatcttaaactactagattcaagtgattctcccattttggcatctcaaagtgttgagattacaggtgtgagccaccatgcccagcccattttccttttagaccctgaatgacacacagtactactcaccaatttacctgacatgaccatttgtagtcagagaatattgtgtgaaacaactttgaattgcatgactgtattagtctgttctcacactgctaataaagacatacctgagactaggtaatttaaaaagaaaggagacttgattaactcacagttcagcatggctggggagccctcaggaaacttacaatcatgacagaaggagatgcaaacacatccctcttcacatggcagcagcaaggagaaatgcagagcaaaagcggggaaaagtcccttataaaaccatcagatctcgtgagaactcactatcatgagaacagcatgggggaaaccacccccacaattcaattacctcccactgggtccctctcattatgtggggattatgggaactacaattcaaaatgtgatttgggtggggacacagcaaaaccatatcattctgccctggcccctcccaaatctcatgtcctcacattttaaaacacaatcataccttccaaaagtcccgcaaaattttaactcatcccataattagctcaaaagtccaagtccaaaatctcatccaaaggcaagtcccttctgtctatgagcctgtaaaatcaaaagcaagttagttacttccttgatacaatgagagtacaggcattgggtaaatacagccactgcaaatgggagaaattggccaaaacaaaggagctacaggccccaggcaagtccaaaattcaatagggcagtaattaaatccttaagctccaaaataatatcctttgactccatgtctcaaatccagatcacactgatgcaagaggtgggctcccatgatgttgggcagctctgaccctgtgactttgcagggtacagccctcttcctggcagctttcacagctggcattgagtgtctgagtcttttccaggtgcatggtgcaagctgtcagtggttttactagcctggggtctagaggatggtggccctcttctcacagctttactaggaagtgtcccagtggggactctgtgtcggggctccaaccccacatatcccttctgcactgccctagcagaggttctccatgagggctctgcccttgcagcacacctctgcctgggcatccaggcatttccacacatcccctgaaatctaggttcccaaacctcagttcttgtcctctgcacacctgcaggaccaacaccatgtgaaagctgccaaggcttggggctcgcacccactgaagtcatgactcaaggtgtaccttggccccttgtagccatggttggagtggctgggacacagtgcaccaagttcctaggctgtacacagcagggaggtctctgacatgccctgaagaccttttccccactgtcttggcgattaacatttggttcctcattacttatgcaaatttctgcagccagcttgaatttctccctagaaaacaggtttttcttttctaccacataggctgcaaattttccaaatttttatgctctgtcacctcttgaacgctttgctgcttagaaatttcgtctaccagatactctaaatcatctctctcaagttcagaattccacagatctctagagcagggggtaaaatgctgccagtctctttgctaaagcataacaagagacctttcctctagttcccaactagttaccatttccatctgagaccacctcagcctggactttattgtccatatcactatcagcattttggtcaaagccattcaacaagtctctaggaagttccaaacgttcccacatcttcctgtcttcttctgagccctccaaactgtttcaacctctgcctgttacccagttccaaagttgcttctacattttcaagtatctttacagcagtgccccactacccagtaccaatttactgtattagtccattctcacactgctaataaagacatacctgagaccgggtaatttataaaggaaagaggtttaattgactcacagttctgcatggccagggataccccaggaaacttacaatcgcggtggaatgggaagcaaacgtgtccttcttcacatggcagcagcaagaagtacagagcgaagtgggggaaaagccccttataaaaccatcagatctcgtgagaatcattcactatcatgagaacagcatgaaggtaactggccccatgattcacctacctcccactgggtccctcccatgacatgtggggataatgggagctacagttgaagatgagatttgggtgaggacacagccaaaccaaatcaatgacatatttagatgaacccaaaatactgtttttcatacacatgccaagcaaagtgaatgagagggttgcatcttctatgactcttcaatctgctgtacatgttcaccatttcaatattctataaagcctttttgtgtttagcttttatttggtcaaagccttaaggtaaaggaaattattaatcacattaaatttgatattgaatgctggtctggcactgaatcttcactgactttgaaagaataatcccctcccagtcctcctctattgaccatcacctataaccaagtctcctcttcctcctttgatgaatacaataaaaattcatatgtgaaaactgtatttattttatttttatctattatttacataaatttagtttgtttaatctatatgttttctatcttttgggtatcttgggttaatttttctgtttagaataacaaaaactttttattcacttcacatattttcacttagttgtaagattttcaaacataaagtcattaagcaaatgtttgtgtacaagacacacagatacagaaactgccaggagagactctgataacttccatacttctaattttgcatataagctgtcttcaggatacacaaagactgagggaagagaagatgctaaatgtaaataatatacatttatttatgtattcattatcaagcatatgttatctgaatgtctttataaagcaatatacaaatagaataggaacgtgatatatttacttccccagttgtggtgtaagcatcctctaaaaatgcttacaccacaattggggaagtaaatatatcatgtatataacgaatagactataaaaaagaacacatggggcaggtacgacggctcatacctgcaatccagaactttgggaggccaaggcagatggatcacttgaggtcaggagtttgagactagcctggccaatgtggtgaaaccccatctctattaaaaatataaaaattagccgagcgtggtggcacaggcctgtaatcccagctacttgggaggctgaggtggaggatcccctgaacctgggaggtggaggttgctgtgaactgagatcacaccactgccctccagtctgggtgacagagtgagactccatctcaaaaaaaaaagaaatgaaaaagcaggaacacatgatagggtagtctgagctctgtacaaataggaacagtaacatagacaaggagtaattagagtaggctgaaaaaaaaatcgaaagatcttcttgaaaaagatcctgaagaaatttatgaaactgagttgactaagggaataaggaagcacgtgagtaaatacagcaacattacctaaattccctttccatcatctctctgtcatcttctcccacctctcctaaccaacccacagggatttaaaaatattattgaatttttatctaaatgtgatggaggatggacaggaagagaattactgattactctcagtcaggattcatcctagcagcaattatttgtaatttaactgaaataagtccatttgactgaacagacagcttggaaatcactaaaatgagaaaggagatgttttagagagtatgacttctataagtgaatgaaagagaaatcacccttaaactcactggtttggggaagtgaagttcccacaaatgtgacacacaggaaattgcctttccacatgtgagttttctgaactgaaccaactgccatcgatttgcactagtaagacagtattcctaaccaaagcagggaaaacaatgatgtgatcccaagaagtccttgcactcccagacttctagtctcatctgtttaatttgacattgtagggaccaagaaaaagcttccccttctatcctctgaaagtttgctgaaaatggactatagacaaattaataggagaaaaagccatacaaaatgtatttaacatgtatagctcaggggaattaaaggaggatggttacccaacaacccagtaaggtccaaatggttatacacccttcctcatagagaaaggggagatgaagggtgtagcagtaaatggttttcagggggaatgagtgaacccaaagaacagtgatctgggacaaagttcctctgagctctggggtcagtggccagaaggtgaaggacagaactttactgtgaacaaaggttgttttattattcagataaagcctctcaggtactctctctgagctgcccttggaggaatacatgaaaagtctgtcagggcaaggtgaggactcctagtttcttctcttgtggttaatctttcctggttatttcatgagattcctagggagggagttttaagacaattgcatttctattttattttattttattttattttattttattattttattttattttattttattttttgagatggagtcttgctctgtcacccaggctggagtgcagtggcacaatctcaactcactgcaacctctgcctcccgtgtttaagcaattctcctgcctcagcctcctgagtagctgggactataggtgcatgccaccacactcagctaattttttgtatttctaatagagatgaggttttgtcatgttggccaggctggtcttgaactcctggcctcaagtgatcctcctgcctcagcctcccaaagtgctaggattacaggcgttagccaccgtgcccagcaattcttttggaaagaatctttcttagtcagctgaggaaattccatagagagtccctgctagtgcttcaggaaagtaagaggatgggggtgaggtgtaggtaagggtgaggagaggtcagagagagataccttgaggctgcttctttagttcagcatgtcaaagtgccatattttggggtattgttttctgagccccagcagcatcaaaggtcatagttcctgaaactgcagagacagcactgaagacttccatgtaggaaacaggatgtctctaaagtgcaaagagccaggacttggatctagaagtgagtagtagaatgggaaagaatctagtcgtaacttagaaaccacctcagtccttcctgggttagcatttgtcatcgtttacttaggctgctgctgaagggatttgattcaagcctctgtgactcagcagtgggcacaagcattgctatcccccttttttctaggaaaattgttcaaaagaaaaccttgacacgaactacgcattaaccctatattacaacatcttcatagagtcaggtgagaagaagggaggccagaggatccagtcttgaatgctaacggtatcttaaacagggtctttattgagttctaccttagtatggtaaattatagttgtaaggagaatggtctcccctttgtcccttttgactacaagaagccggtgctcaccctctgaaaagtcagaagatgtataacatctgctactcctaccaaatgctaagccactatgaggatatgatgctttatttttatttatttatttatttagagacagagtctcactctgtcacccaggctggaatgcagtggtgcaatcatggctcactgcagcctcaaactcctgggcacaagtgatcctcctgcctcagcctcccaagtagctgggattataggcatgagccaccaggctcagcaatgcttatgtttttttgtgcgtgtgtgagacagagtcacccaggctgaagtgtagtggcacaatctcagctcactgcaacctctgcctcccgggttcaagcaattctcctgcctcagcctcccaagtagctgggactacaggcacaaaacaccacgcccagctaatttttgtatttttttagtagagacgggatttcaccatattggctggtcttgaacttctgacctcgtgatccacctgccttggcctcccaaagtgctgggattacaggcgtaagccaccgtgcccagccaacaatgctttatttcttgactctctttctacacccctactgcaaaagactaattttccccaaagaggacctgattttgactgaattttagcctcttcctcttccacatgataaagctgctaattgcctgagagaagactgctgagttacagtgtagagggaagcatactcagggacaattagcaacaattctgtttctgttaaaccttataattcttatatcactactgcacagaactagacatggagctagtttatgtctcactgtaccatttactaattttttgaccctgatgaagtaacttaacctcttgtagctttatctcatgtacaaaattgagacaacagtaagatgttctcatctaagtaaaatgttgaaatgttggagtgttccaggcttgtttagatagatggaaaacacacacacactcattcactctctctctctgttactctgtctttccaataagtcttgttttcacttcttaagaatcagcctagaggtgactggaggaagagaaactaagttgtggtgacaaagaacaagactatgagtaaggatcactattacccttacagactggataaaaccctaagaaacaaaatcattgtgcaaaacctttcaggccaggcacagctgctcatacttgtaatcccagcactttgggaggccaaggtgggaggatcacttgagcccaagaattcaatgccagcctgggcaacataagaagaccttgactctacaaaaaatataaaaattacccaagcctggtagtgcatgcctgtagtcccagccactcaggaggtgggacgatcgcttgagcacgggaggtcaagcctgcagcgagccatgatcatgccactgcactccagcctgagagacaaagcaagaccctgtctcaaaaaaattttttttcaaggaatagaaccactgcacatgctcctcctgatcccccaaagtgtaagattttcctgcaaatagctatctcccaggacttacattagtaaggtatctggatataaaaatcagtgttccctaaatcagctgtgtttccattatatcaaaaataaacttttagaaattaccatttgaattaacaaagatacacacacacacacgcacacacctagaaagaaatcccgtaagatttgtgcagggcatttatgaagaaaactgtgcaatttatgggaagttattaagaaagaccacataatttaatagatacattaagtttatggtttagaagactcaatgtcattaagtacaaattttcttcaaatttgtttacatattcaatgtaaatctaaatcccaacaaatactaagaaagctgacaacttgattcaatgtgtacattaatgagcaaaaatccaagaataactatgaaaatcctgagatgattaaggagatgtgcactaccatatataaggatgtattataaagctataatattaagacaatgtggtattgagacaaagataagcaaattgctggtcaaatagcctaagctctaaaaacacatatatatgaaactttgtgatagaattgtcagttcatatcaaaaacaggatgattaggtcttttaaatggtactgacacaactgcttatacacaagggaaaaaaaagaaattagatacctgcttcacatcacctacagacatggacttaagacttaattgtaaaaggcaaaactttaatacttttagaagaaaatactttggaatcagcaaagatttcataagcaagacaaaaatactaatcataaaataaaatactgacaaattaaacctcatcaaaattaagaacttttgtacatgaaaagacaacataaagaaagtcaggaaatgagttgccaatcagaaaaaaataatttcaacagaagtaagccatgagggtttgtatcagactaaatttttaaacctttataaaccaataagagatagacaaaagtgcacactatgaacaaaataaaagccacaaacagatatttcatggaagaaactgcataaatggtaaattaacatatgaaaaaggactcaacctcatcagtaatcagggaaatctaaattaagtctaccatagagtactattttataactacaaaaatggaaatggggactaagaagtcttcttacattatataaaccaaaaataaaattgtaagaccccccaagcatcttaatggacccctcctcttggccaagggcattccaaagtgaacctgaaaaactagttaaggccatgatgggaagggggagctgaacatgcctcatcataccctcctcccttttggaattactggtagaacagactctaagtctgataaaaaaaataaaaaataaaaaacatttacaatctattctctctgaagtctgctgcctggatacctggaggcttcatctgaatgacaaaaccttggtctccacaaccccttatcacaagccagatcttcctttctattgataataacgaattgccaatcagaaaatctttgaatctgcctatgacttggaagccaccccacccctgcctgctgcttccagttgtcctgcctttccaaactgaaccaatgtacattttacatgtattgattgatgtcttatgtctctgtaaaatgcataaaaccaagctgcatcctgaccaccttgagtacatgttctcaggatctcctgagggctgtgtcacaggccattggtcactcatatttggctcaggataaatctcttcaaatatttcacagagtttgacttttttgttgacaaatactaagtgttgacaagggatttagtgacatagaaatccttatatcctattaatgacagggcaaagtagtatagccatgtagaaattaacttggcatcatcttataaaattaaaaatttacacatctataacaccttatttttctttcggtaccttttaaagatgttgttgctacattgtcttctcacttgcattatttccaacaagaaatctggtgttttctttgtgcctctgtgtgtagcatgtctttttatctccgatcacttttgagattttctctcactaactttcagtaatttgattattaaatccttatgctgttttcttcatggtttttgttgtttggggggtgtttttatttgtttttgtgcttggggttcattgagaatcttggatttataaatttatagtgtaggggagaaaaaataatttttcttctacccttctgagttctcagctgggacttttataacaagacagattaacaagagaaaagcagataatcagggaaaaatgagtaactctcaaagaggtggcctagaattttggcttatgtagcatcttcaactaaaagaaagaaagaagggtgttgggaaaacaagctatgggaaagcgttcaggaaaatcaaacaagagtaaggtttattatgcagatttaaattggtgccttctccattggtaagagccttttgtgatttagtcctccttcttttcccagcccagagagggagatagccttagaaatggagatttcttttaaaaatgtaaatttcccttacagaagggtaacttctactgtgtttttagaattctcctgtgtctactgtttctcaaaataatcagctcaaaataatccttatgccaaaaagtcatattttagggtggcacatgcctgtctcctacaagttttcatcaagtttgaaaactttttggtcattctttgttcaaatattttttctatctgttaccaggaaggggtcccaatccagactgcgagagggttcttggatctcatgcaaggaagaagttggagtgagtccatagagtaaagtgaaagcaagtttatttaagaaagtaaagaaataaagaatgactactccataggcagaccagccccgagggttactggttggctatttttgtggttatttcttgattatatgctaaacaaggggtggattattattcctttccaggaaagggggggggcaattccaggaactgacagttcctcctctttttagaccatatagtgtaatttcctgacgttgccatggcacttgtaaactgtcatggtgctggtgggagtgtcttttaacatgctaatggattataattagcatataatgagcagtgaggacgatcaaaggtcactttcatcaccatcttggttttagtggcttttggccagcttctttaccatatccttttatcagcaaggtctttgtgacctgttccttgtgctgacctcctatctcatcctgtgactaagaatgccttaacctcctgggaatgcagcccagtaggtctcagccttatttcacccagcccctattcaagatggagttgctctggttcaaacgcctctgacatatccaccttcctcttttttcaaggactccaattgtaacgctaaagatttttgccttagccagaccaaagaattggtgtggcggctgcccgtggcgatggaaacacggaccaagagaaaaaaggctgtaggctttattgagcagagtgacagtacaaagcttttcagcgtggaaggggtttcgagcgggtagtcagaggtcgatgatgcagttgcttttgaaactctttaaggcgggaaatacgtgtagagggaagatgttaccagagcgagaaacaaaggcagtaaattattttgtgacatgtcttagattttgaggaaaaccagaattgtaacttaggttttatttattttatgaccttgcagcagcatggcaaaggaaacaatcttacaggactttataaagtatgtttacaaggaattggaattgggagtatagataaagttcgctggtcatagaaaaacaggcatttaatattccttttagttttaggggagggggaagggagagagggagagaggacacagggaagcttacagcaaaatttttgctgtttatagctttttttgggaagaaaacacatgcacaaatcctggtgttaggaatattttaagcatatatctttaatattattcattcaggaccgaagtaagttctgatgcagaaaatgagtgagttttacagctttctgagcccctgtttgactcaggaagcccagctggccccctcctttcaaaattacacatatattaggccacttgaagttgtcccacacctcactgatgctcttttcattttttttttaaccctctgtttcattttggattgtttctattgctctgtctttgcattcattaatcttgttttctgtggtctaatgtgctctcaatcccatccagcatactggtattcatctctagaagttggattttagtgtttttctattttccatgtcttaattgaggtaagacccttctgggttctctatcacatgccttgtgaattgtgctctccttttttgggaactggcactatttccagccctgtgtgactgttgggtactgttctagctaatgctttcaagtggttctttcctggggtagttttttcacacacgtgcacctgtgaaattaaaaaaaaaaagaagaagaaactttttatctgaggaatgtgagcccctttaaattatcaggctcagagaggcattggaatgaaactgcagtcacatcactcccccttgagtgattatcttgtaaagccacttgctatacgggctccagactaactgatgccaagcagccataaaataacatatgctggacaccacgactcatatcctatagttcaacagtgtataaccaataactaatccatgtcatctctgtaagccaatgaaaatttctatcaaagaactttgtatccatccacttcttcttacctttgcctttaaaaacctgcttgtaacaaaagctgattgagcactccctgagttaacttggaagtgtgtcctgggcagctgtgctcactttggctcaagtaaactctttaaattatatcttgtgcttcagccccttccttctagatcagcacactgattactactctgctgaatacttggtggggaccctcagcagatctctggaattctctctgtgtgcagctttttcatttccatttcttggatccatgagctctagccaccttggtctctccagactcagctctgtctcctcaattctgggactccactgggacctgcctgagttcccctgtaccacagcctggagaccctctcaatgcagtagatgaggcaattgcagggctcatcttttttcttccctatctctcaggggtgactgtcttttgttgcctgatgtccacagtttcaaaaaaacattgtttcatgtattttgttcttttgtttaattttgtttagtttaattttgtttcaggtgagaggataaatccagtctctgctactccatctgggctggaaatctggtatatcattaataatattcttgttgttaatttgggttgtgggtttataaatgttcattttcttattttgcatcattaaccatatacacatatatattacacattttttcatttgcgtaaaatattagtcaacttttttaagttctaaaagaaagtgaagagccctggggcggaacaagggcaaagaagtaggaagagtctgtggccaacctcttaactcacgtacctttctgacccctctacctcttctacctagagccctccatctcagccagctccccctgtccttgtcaccatgactctgaaggtgcctttctgacacaccaagatggtcaaggaaaaatggtgctgggttaggtgacagggaagatcatgagctttcatactttatgatctgacaagccactgtagcctctcacatttatatactaagtgagggtctttcagaatagcgcttcagtgtctgcacctgactcacactattaggcagttaaaagctggggaatgagctcatgtgaagagtttttccatttcagatcatagctatttttaggaacacaagctacataaatgttttaacccttttcccatccttttcctcttgctgctgtgatacaggaaggaaatcaaaatggagtgaccttgctatctggggaaagatgaaaactgcatatgcaaaagcaaacagactgagatttataacgagttgatcccttaaaagcttaggaaagaatctcaagggcacataggaaaataagcaaagggcttgatagacataatcatgacaacacaagaaggtgaagtcgggaagaggaaatggacaaggtcatcccaaattgaaataacttataaaagataaattataatatctccagaaattaactgtaaacattcctataaaatcatagatgataattttttaaaataaaagattgagtagtaagaataactaagaataaaaaattaatgagttcctagtggaaacttaaaattgaaccactgggggactttctataatgaatggcagttgaagaaaaaaatcgggtaaactttatatgaatatttgagaaacacctcaagcattagcaactacataaaagttatacatttcacctgtccaagagctgttacaacagtatacaaaacatattaagcaaaattgtactatagacaattacttatatgcaattctttacttaaaatttagcagatacatttgaatagtttctaaaacacatgatcatcaaagaaggaattgagtaggaaataaagcattactgttttttactcataaagagatgaaaataaaataaattattggtcaattctttatgagatttaaattatcttagcatttatttgtttgtttttgagacagggtcttgctctgtcactcaggctacagtgcagtgacacaatcacagcgcactgcagccttaacctcccagactcaagcaatcctcctgcctcagcctcccaagtagctgggaccacaggcatgaactaccatgcccagctaattctttttatttttagtagagacaggatctcactatattacccaggtcagtttcaaattcctgggctcaagcaatccacacaccttggcctcccaaagtgttgggattacaggcatgagccactgcacccagcctatctcatcttttaaaaaaaacatatcaaataattgttcataaatcattttctatagtagagagcaatttttcttaaaattggcaaataagattttgcatctacctttgagaaaattgtatttgtaaagtgattttaaaagaatgaagcctatgagtatgatggcattataaaagtatcagtggccaggtgcagtggctcatgcctgtaatcccagcactttgggaggctgaggcaggcggatcacaaggtcaagagattgagaccatcttggccaacatggtaaaaccccgtctctactagagatacaaaaattaactgggcatggtggtgtgcacctgtgatcccagctactgggcaggctgaggcaggagaattgcttgaacctgggaggtggaggttgcagtgagccaagatcgtgccactgcactccagcctgggtgacagagcgagactccatctcaaaaaaaaaaaaaagtattaatgtatggaaatacaaatgtcatatatagatgtaaattctcctaattgttcttctgagcatcatgttttttttccatgaatttttattttaagttccagggtacatgtgcgggatgtgcagtttgattacataggtaaacgtgtgccatagtgatttgctgcacagatcaacccatcacctaggtattaagcaaagcatttattagctcttctacctgacattctccctcccccaaccccacccgactggccacagtatgtgttgttcccccaccatgtgtccgtgtcttctcatcgttcagctcccacttataagtgagaacagagcatcatgattttcattgtccatcaaatgctagaagactactctgcttttgttactatgtttgccccatttttctagctcttcttacatgaatttaaacctacatcaatggctatttcctcaacatttggaaacaacaatacttattagaaagaaagtattttatccttccaggctatagatcttacattcctcttacacaacaatcctaattccctcatgttatcctgatcaatgaaatgatttcacttatttttcaaagaagtagctattttactacaaagcaggaatcgcaaggcttggggtgggcactgttatactccatcagtgagtatgtaaaggaaatcaaactgtctgattttgaatcctgcttctattttttacaaccttggacaaattactgatttcctctttcactaggtttatcatttgtaaaatggagatactagtgtctactcatggattattgtgaggcttaaataagaaaacatgtatcaagcatatttgtctggcatgtaataagcactctaaaatttatgcagcgatgaggataatgatcctagacaatctgatagcatcttatccaaaggaaaaaatgcgcatttcctttgagtaagcactactgattctaggaatgtgtcctaaggaaaaaataagtcaaatgtttaaaggtagtcacaagactattttggtagtaagcagtcttttttactggtcacacagtaaaaaattagaaataacctacatgttcatgaagagaagttggtgaaataaattatggtacatgcatacagtagaaaactttggagacaaaatagtaaaatagttacagatataggctttgaatataaattttaacaagctgaggcttctctcgtctcttcagaacaccctgagttcttcccggcctttcttccttgcttttcatttgtgtcagtcagctcttgcttgtacagcaatcttcaaatctcagtagcatataaaggtaagcatttagttctcacttacaagtttgcagggcaggtgaggcagctctgcctcaagccacaatgtctaggacagctctgtttcgcacggtggctgactagctaaaaaatgttcttgtctcagcaatcacaggagaacaagagggtgagagataatgtgtgaagcttcctaagtgctaagtttgaaattagcaccatgtcatttccattcacatttcgctggccaatgaaagtctcatgatgagccacagtcaagagtcagagacgtaccctcatgaggctgtggagagagtgtagattcagggagcggtgagaaactggggccagtacaccaatctacagcatgatttgtcatcatttttcattctctgctagtaagattgccaaagtctctctgcactcattgaattcatcctagtttccatttagctctctttctctcttaccacaatacctaaaaatctttttatggggttacaactctgtctcaggagccacctcagtttggtggcacagagctccccacttgtactctgaaactcttttcttgaagatattgttatccatgtgcatgagttatttttcttctccatagcatccacattaaacaattaattaccttggatttagccaaaataaacactccaaattcatgatgtctttcaggaagagagtttgttttcttttttaaccaaaatgggagattgatcctgtctgtgtcccctagaggagcagaggctggtttgtattagggcagctcttgtagatgagtaacttttcccatggcctcatagaggctgatatagatacttctggattcaaatgattgtttggaggcattagccaggcattgaaccaattataaagagtgaggttttgccatattctaaccgtaagaaacagaaacggtagagggtaaaaatagaatagaatgtcaacacaactttagccttttccctggattctgagagttcataacctgaaaatcagagattcaaactgggagagatgggctaacaggtatgagcatgggaaaagcatgtttcaaggatttgagatgtatttcccagaaaaggaacatgatgaaaatggtcagaaaaggcaatttccttcctcttttctaatttggctctggagccaccagcagaacctcttcaatatcttgcatgttacagatttcactgctcccaccagcttggagacaacatgtggttcttgacaactctgctcctttggggtaagttggactcagaggggacagttagaagggtacaggctgtggctgttgtgagtcaagagttttgtcttcctgtggtaactctgggtagaactcatgagtatgaagcaacttgtatctgtgcttccacggtttattagagcttattttatgaaaaggatgggaagggcaaccctgaggtagcattaagcctggacgcaccgcagtgaagtttccttgataaccacctgtagcttgttcagttctgttagtactggattttgagaaagagaaatagaaactcaagagatctgagttgatccctcagagtctacattaattctgtctccccaattctctcttcctcattattttccttggaccaactgatatctttattctctgatctcttgcagttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctcccctttactccacttgatctttttctttttcttcttgtaatctccaagtagacaccacaaaggcagtgatcactttgcagcctccatgggtcagcgtgttccaagaggaaaccgtaaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggtaattatgacttggaccaggagggccggaaactacaaggtcttcctctgcgttctctcctttctggatgccagatgtgtgtgtgtcgatttatctgggtgcaggtctcagcactacgtacctaccaggtgacactaaatcagtatactcaaaacatcacagcagggtccttaaactgtgtaccaacagtacctcagctgggccagctctaagtaggatgtctagagtaagacttcggccctaagattgtatcattattccaaatgtatgcctgtacatagtaaataataataattcaaacaaatgagcaataatgaacaatgaaatatcttcctcccacccaaaaccctagatctgcagtcaccttccacagaaacaaaactgctaatatatatatatacatattatgcatatatatgtatatattagcattattatatataaactatatatatatatatatatatatatatatatatatatatatatacacacatatatatagttttaaagctgtgggtggtagaacactttctaagtattgtcctatatcttacttttatcacttaaaataccttgaagttctgtttatattaatagaaatccactttaaaatgtctgctgcacagctgtaccagaattaatttaaccattctgcctattagcaaatttataagatgtttccactcttttgattttacaagcattgctgcaataattatctttatacatacattccgggggcacatttcatagggtatctgtaagataatattctggacatggaattattgtcatattttaataagtggaagcagaaaagcccaccacccacttaaacctgtaaggagtttctattcatcaagagatggagactgcaatattcttcagggaaaaatgcttcattcaatatgcaagacaaaataaccaaatgtattatttagttattcagaagtgatgagtttaaacttctttaaaaatgataatgcaaaagttaatccacactggaggcaaaattgcctttatgcagacatggttgctgttagaggaaatgtgttttagccaaggaaatgttgagaatgtctgagggaaggcttgatgttcctcatgtgtcccttaggtctctgtaaataagttcttaggatggagaggttagggaagctgacagagctgtttccctttttttttttttttttttttttttttttttgagacagagtctcactccgttgcccaggctggaatgcagtggtgcgatcttggctcactgcaacctctgacagagctgtttcaacaagacactttgggtaattcaagcagaagtgtttcatggttcaagtgacaacaaaaggactagggctgggaagagcccattttctttacctctacacagactctaggacactcagcatcagtgacttactgagaatcatatcttttttacattacattttaatgtgaattttcattgaaatataacttatgtacaacaagccataaatgtacgccacagtaaattttttcaaagtaaacagcatccagatctattttagacatttccagcacctcagaaactccttcttgcccatttctagtccacccctgacactgacttccagcaccataggttttttgcctatttttgaacttcatataaagggctacggtatgggacaggatgtactcttttgtgtctggtttatttttctcaacattatgattgtgaacagtatacatgttgtaaattgaagttcatttgttcttattactgtatatttcatattttcccattctgctgaggggctcgggttgcttctggttttgaccacttacaaatagtaatgctgtggatatttttgtttacatgtttcaaatattttctaccattactaatgttcgacagtatctgatggaggtatgttacaatttcccactcttttggatatacaaatgcaaattaagcatttccctaatgactatgatattgaccatttttcacgtttattacctatttgggtatccttttttgtaagctctttttgataatttttctattgtctgtctttttcttactgacttataggagttatttatatattctggatataagtcctttttcaagtgtcttaaatatcttctcccactctgtggcttttcttttcactataatattaaagttttgtttgttttcaatgaacaagacttgttaattttactacagtacaatacaccaacatttttggttggtgctgtctatgccctattttaaaatgttttgccacagtcagccatggggaattcaattgcagctcactgactcttagtcatttcaatttaatcagtatatgctaagaccaagaaaatgcagctggttggtggacccgagccctaatcatatggctgacaccaaagtcatgaaggtaggggaatgattgttgagtaggaaattagtaatgtctgctaaaagctgcatctcgtgagttttgatatataatactaccattaccatttaagtttaaaactcataaatttctgttatacattattttattcatgaattacttagatgttttttggagggtagttttttgttattgatttctaatgttatagcactttggttagaatttgtgttaaacatggtatcagttcattagtatttgttgaaaattgctttgtggcctagttcacacttaatttttctaatattgcatgtgtgtttgaaaagcatatgaattttctttctaaagtagagcatccacaaaatcaagcctattaattgtgtcattcagatattttctaccattactagtgtttgacagtttctgatggagatgtgacagcatttcccactcttttggatatataaagcaaagatggcagtgtttggacagtgcagtctttcagcatctgctggctgtgggtgggaataagggagggaagagaattaattctatttggaagcattatatcagtatccatgactgtaaaattcatgctatgtatagcatagaaacacctgccttccattcttagataagttctggaggggaaaaaggcactattgtctcttttccgccttagtctcctaagaaccccatttttacttagccaaaccaactgcctctggagaaaagaaaagtagttgaagcatttttggttatgtgtagaggtgtttgtcgaaaggaaaaacccattgacttggagcttgttttgctagtgatatcattgatcttacatatgtgagtattcatatcaatgtagtaggatgtttatatctggatgtttgcccttctgtgtgtttgtctcaggatgcgtggtcctattaacaaatttgtcaagagttggagtgtatttgttttctattgctgtgtaacaaatttagcaacaacatacatttaagatcttccagtttccatgggtcaggactcccatcacagcttagctgagtgctctgctgagagtcttccaaggctgcagttagggtgttgactttgctgtgtttctgtttgcagctcttccaggctcacaaggtcactggcagaattcagttctttgtggttgtaggactgaggttcctgctttcttgctgcccatcagtggggggccactctcagctcctagaggcccttgccttgtggcactcttgtaggccctctcctggcgtggcagcttacctcttcaagttcaggaggagactttccatccagactgctaagatagagtcttacataatgtagcaatcccaagagtgacatttcatcacccttgtcatattctgttggctagaagcaagtcataggttccacccacactcaaggggattatgcaagggagtgagtcattgggatcattttagaattctgcctaccatgctgtatgaactgtttttgtttcaaccaacttctgagatctggaaagggaagataagaaagggctgtgtacgcagttgccagtaaagattgcttttctttccaccaaagctaaagatatttgaggaactggatataggcctgagatttagcagagctctgaggctggatgttgcaaggagaaaaaataggaagcccacagggccaagcttgggcctccttgtacctcctccactgtatacatacattttgggttcatatttttcaggctggccactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcaagggaaagcatcactacacatcagcaggaatatcacaatacactgtgaaaggtattgtattggaatagtcatagaactgatagtccctccccctgagggaccatcataaatattctaaactcctcactttaatttacaagtgaagaaaccgggctccagagaggtaaactgcattactaaaggccacaccatgaccagtagctggaaccagaactgaggtctctgggtcctagtccaatactctttccagtgtaccgcaagccccatcaataatcacaggagctaatgtcaatgtcagggcataatggtgatccatttcatccatcattattttagttgtaaagaatacagactcactctaggtagataggagagttagaaaataataccatggaatctcatggaagccccatagaaagagaaacctggaaaatatgaggaacgggctatactgtccatctacctctcagggacaaagcagcctctgtggtgccacttcttcctgagcatctgcaggctaagcagtttgcatatggccttgttctgaccctttcacggcctttcctcttaatacaatcactagcaacctttctctgtctgagaaaaaaaaaagttcactcctgtgggaaagaaattattgtcccagattatcttttaaagtcaggaacaaaaataatgagtcactgaaatgtggcgggcacctgtagtcccagctactcgggaggctgaggcagaatagcatgaacccgggaagcggagcttgcagtgagccgagatagcgccactgcactccagcctgggcaacagagcgagactacgtctcaaataataataataataatgataataaagtcactgaaatggcaagtgtgtgagtcagggttcactcctagttgaccactgccaaaagggcatggttattgaccagatgacatggtcattcagggaaggatggaccatgtagggcaggggttcccaacccttactggtccgtggcctgttaggaactgggctgcacagcaggaggtgagcttcttcatgagccagcattacggcctgagctcctcctcctgtccaatcagtggcgacattagattctcatagaaacatgaatcctattgtgaattgtgcgtgcctgatgatctgaggtggaacagttaccttccaaaaccgtccccacttcaccccccggctgtggaaaagttgccttccacaaaatccatccctagtgccaaaaaggttggggaccactggtatagaggtatcctcagtaggactcagcaagctggcaaccctaattatgtctattaggacaccccaagaatggctctctgctggaagtaaaaacggttaatgccttatggattcattttctaaggccaggtttcccaagggggtaaagggcatgtcttttgtgaaaaggacctggatgctaaacaggcaaccctttcccccatcaactttctccttagagctatttccagctccagtgctgaatgcatctgtgacatccccactcctggggggaatctggtcaccctgagctgtgaaacaaagttgctcttgcagaggcctggtttgcagctttacttctccttctacatgggcagcaagaccctgcgaggcaggaacacatcctctgaatactaaatactaactgctagaagagaagactctgggttatactggtgcgaggctgccacagaggatggaaatgtccttaagcgcagccctgagttggagcttcaagtgcttggtgagtgagaatgacgggaagccactggcacagaagaagggactcccttatctcccatgggactgaggtttgttcaagggtttttggcccagacaggaggggaaagtctcttcaggaaaagcccacaagcaggcctttccatccttgattcacaacatcactcttctcctcgcaaactgttaaatttcctttcctttctttttctttttcctttgcctttccttcctccatttctttccttcattttctcctctgtccttcttttcttctccttcattttattttcccctccctcccactcttccctccactccatgacccccgcttctctctctctctctccctgcttccctgcctccctcctcctcaccaacaatctcaccaacaatttatcaagttcttcctatctgttgtcatacgtctggggatataaagacatttgagtatagttcttgcttcaaggagctcacaaggtggatttatcagacagtgattttgtaaactgcaaatcaccacctccccaagtatctctatttaactgaggcagagggattgtgagctccagaacaaagtctccttgggggggaaaaaagttcatcttcaacccaaattcatttcaagtattaaatggcacagagatatcagttgtctctggaactaggaagtaagtccactgacagggcccagcaattaagctcttccaaggagcctgtccctgtctatacaccatatagccagttagagctaccgccagttccttcctgctccctgaaatgaccagtgcctccctgaggacaggcacatcaggtctcagccaaccttcccttccaaacataactcagccagacccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgtccacttgctccccgtgagcactgcgtacaaacatccaaaagttcaacaacaccagtctaaccagaactgtgtgtctcatggtatataactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagtcaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctttttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacagctgaggtaaaaactgaactatgtaaatgactctactaaaagtttagggaaaaaaaacaggaggagtatgacacacacagcaacttgattctagattatttggtttgatccgtaaatgatgggatggggcgtcgcgctccgagcgtgtcccacggcgggcccctggcaccacactgtggccgcatgtgcatattgcagcctccgcccgtatctgggggccgcagccgccagcgcccggggacccagctgcggcgaaagctgtcgggcgcgcgcttcgccgcagctccgcgcccccgccaaaacccagtgagaaattatttgcattcctggagcctgcaggagcgagaaatgagctgtaggagtcggtgggcagcaacggcggcaggcggatggaagagagcaaggggtcgccgttcgtgtcccattcgcccgagtcaaggggcggccccccaaaatcccaacgtcattgtttcctcggggccggcaggtgtgaaaacccggcggcagaatggaagttcggtagtctgcgagggcccgcggcctccccaggcgcgtagctgagtccctccaaccccgccccgggcccgcctgctcccgggccccggcgcggcgccacctggcggccgtctgtggaggttgcagctgccgccaagccacggggatgctgccggcctcaggtgcccccggccgagcctccgcggagaggaggactggtagatcacaggaaacgggaggacggcgctgggctcccagcaggcgccccagcttcttggcttgtcgcaagagcagccggaggcggcggcggcagggagggagcgggtggggagtgggagaggccgcccgcctccccgtccagctcggaggacctcccagctggttccctcaccgtcaaaagcaggaagggagctggctcggcgggatcagcaagccagcgggcaagaaggctccaggctccgcaggggccaccccacatggactcgggaaccgccgagcttcacccacaagggcccacggcccatcctatcacggatgaaaagattacaggactgacaatgagcccctggagggatctgatgcagctggcggggagaaaggtgggtcggacttagaggggtggtggggtggaggaatatctttcttctccctgggacctaccgaggcttcacctgtgagggtcttgggcccatccttcaatccgagagcttccaagccaaagcacagctccccagagtggacaagtggagcagaaccggcattaggttgggagggtgggtcgttagggttagttcttcaccttccaggctgggtatggagacctctaaattcatcctagggccacaagagcttctgtaagagttcaggcccgtttcagaacactcagaggttcctagcctgagaagtaatccccaaagcagaccaaccggtttggggtaaaacaggaatagttgggtccattctggatctttcctagctaaatgccttcaggatttaggaacattttcctaggagggccaaggattagctagacctgcccagcgattccagccctgagaaccagacagaatggaggtatagctgacagctggctgggagggggctgacggtcctcactgccaccaggcttagttggagacagattccccgggctgtagagagacaacagtagaagcaaagagaccagttaggagtctaggtgagaggcagcggcagcctggactaacatggtaacagtggagctattgagagtggtcacatttggaagatgttttgtaggaagtgtcaacaaagtttcttattgattagatgtagggaatgtgagaaagagaaggggggggaacacgtagattttgggtcaaagcaataaatattccattgacagaattgaaacagcaagttggtggaggaggggaacggggtagcaagaagcgaatgtttcatattggacattttaagattcctatttgacatttaagtgtaactcttgaaaaagcaatggatatatgaagaatcctagactagagatacaaatttgccaatcatcatatagatgtggtatttagagtcaggggactagaaagaacaatgtaagggggaagtacagatagaaaaaggtctaaggctgagccatgaaatatgccacattttagaggttgcgtagaagaggtggtagcaaaggatattgataaggagtaccagtgaggtaggagggaaaacagagaataaaacgtctcaagaaagagagatcaactatgtcaaattctcctgagaaaactattggatttggagtgggaatgcactaaatctgtcgatctttttggggcaggggcgggagggagagggttagggaggattgatatcattccaacactgactttccaatccataaacaaggtataactctcatttatttatgtcactgttaatgtctcacaacaatattataatattctctctagatgtgttagatgtattcttaggtccttcatttttgtgttattgtaaatggtattgtcagaatcttcagaagtaattattggccaggtgcggtggttcatgtctgtaatcctagcactttgggaggccaaggtaggcagacacttgagccaggtgttggagaccagcctgggcaacatggcaaacctcatctttataaaaaatacaaaaattagccagtggcacacgcctgtagccccagctactcaggaggctgaagtaggaggatcaattgagcccaggaggcagaggctgcagtaagccaagatcgcaccactgcacttcagcctgggtggcagagggaaaccctgtctcaaaaataaataaataaataaataaataaataaataaataaataaatgaatgaatgattattaccagtctcacagctgaggcagaaatttaaaacaaataaataataagtactgcatttattcactccaagaaaagtaaaagctaaggcccagaatgtggcaaggcaagggttaaaaagaagagaacaagttttcctctgcctagcaagcttacttcaaggacagttataagataacgctgtccaaatagccaaggtcaaaggaataggctccagacacccctcccttccagagcaaggttggaggaagaaaaagagaaagattcttttactcttactctttccccaggcctcttaagcattatttacaaatgtctgtatttagccagtttttgtttttctttcgatgcaactacaaggtcaccagctatgcaaggtcacaagttatgttatgctatagattatgtgacctgtcactgtatgattaactgcttttgttttgtgtctgtaaggccgcttataaaaaccccactctgtctttgttcagtgctcagctttttagatgcaaacctgctgagccgtgtgtacctaaaataaacaacaatcctcctgtttttccatattggcctctcctttcctcagtttaccacaacatagccataatagtataaaaactgaaagaccctaagacacatatacattaagcttggcaacggaaagcaggatgtcacacacacacaaagctagtaatgtgaaaatctggtcttgcataaggtcttttaggtacagacttctttgttaatgcacattggcaggaaaatgggaacgaataaaattgcttgctgtccttctccctttattctccacttcttgttttttctaaatgtggggtcaaaacttccatgagggtaagaagttcagttttctgcctttccccttcatctccctatcacacatgtatactactccttaacacttagagaagataaaaaaagaataaattgtggagagggagcatatgtgaaagtaaaagattcccagacataatacgggagttaatggagaaagaaaatctctaaggaagactagaaataattgggttagggattctcgagaagtaaattaaattccccaaatatggtattctctgagaagataattttgaagaagcaatggcgtgatatccagtgaaacagcagtcctctggagcctggctgtgacttcaaggcccagttcttctggaagggcagaaaaatactttgaagaggagaaatgggcatttatataggtttataagtaccatctttattttagaaaataatcattttctacctggaattctagtttattgtgaccaaagattgtaaaatttcaggatatggctgaattaaaatcttggtcctgcacttaaatagctccttgaattgcaatttcttatcccaattattttatcctttcattccactgtgaaatctatatcatggcacttaatagtcaactttattattttaatttaacaaatgcttatttacctttcatgggttatttcatttagccttcataatatctcttgtcattgcctcacactcagtcggtggcttttaatactattctattattttgatcaatttgtataatatattctctcctcagtgtttggtaaagctgtctgggcttgcttttgtttgttttttgagacagagtttcgttgtgtcacccaggctggagtgcggtggcatgatctcagctaactgcaacctccacctcccaggttcaagtgattctcctgcctcagcctcccaagtagctggaatcataggcacacgccaccacacccggctaatttttgtatttttagtagagacaaggtttcaccatcttggctaggctggtctcaaactcttgacttcaaataattcacccacctcgccctcccaaagtgctgggattacaggcatgagctgccgcacccggccttggtgctatttttaaggatatgtatatctgatttttttttctgtttctcttatagttaattctttagtcaggtattttacttttcttagctcaactttggtaatttgtatggaaaagtcaacattttgtctacatttgcaaatatatatcaaaaatacacatcattttaatatcttctatatctagtattacttatgtgctttttcaatagtaagtttacggaaggattaactcttaattttcttttcagggaacacagtgtttggttttataaattccattttggtggaataggaaggtatgatctgtttcattgactatgctttcatcttactttatgccttctactttccacaggtttttgttgtgttcctttgttagcgttggagttaaaagcttaattctctctctgttgctcaggctggagtgcagtggcatgatctcaactcactgtaaccctccacctcccaggctcaacgatcctcctgcctcggcctccctagcagctggaactataggcgtgcaccacgatatccagctaatttttgtatttgttggagacacagggtcctgccatattgtccaggctggtctccaattccagaggcaataattgggaggccaagacgatctgcctaccaattattttctcttaaatgcattttaaagctacaaattttctcctgactgcttcatgtaggttttaatattatttgccatgaaatatatttcacagtggaatgacagataattgggataagaaatggcaattcaaggagttatttaaatatagggctaagatttgaattctagcttactgggaccaaagcttgtgaagtctcagggtatggctgaattatagtgctcttgttatttctaaagagcgtataatttttattctgatatcccctttaacccatgtgctttttcctaagagtacaacttaaggagggcatgtttgattattttattgttttataatcagttaactatgccctggtcctatatggtttcagcttttcagcacttgttgaggcttaatttgccatctcacttatggccaatttttgtcaatattctatgtgaatttgaaaataatgtaactttcctattttgaatataagatggtataggcataattatagttatgattaatcttattaaccgtgttcttcaaattctccatatcctcaataagtttcagtcaactagatctgtcaattcctaagaaaggtatattaaacttatcactgtgattgttgacttatatgcacatatgtgtatgtatccttgttaaatgcaaacaattcatggtcattccttaatggagcactacctttatgaatatgatatacccttctagtgccatatataaatgtatttttaaaccgacttaaaaaaaaaaaaaaaagaggaacttgctctgtcaccaggccagagtgcaaaggtgcaatcatagctcactgcagcctcgacctcccaggctcaagcaatcctcctgcttcagcctcctaagtaactgggactacaggtgcatgtaaccatgcctggctaatatttttactttttgtagagacaagggtcttgctttgttgcccaggctgatctcgaactcttggcttcaagtgatcctcctgcctcagcttcccaaagtgccaggattacatgtgtgacccaccatgtaagcccacatttttctaacttctacagtaataatatctatatcctatttatttataacataaatcttacttagcttgttttacttctcttcactcttgctttccctaccacccttctacatcacctggaatttgaattccaggttttctttttaattttctagaatctaaattcactttgtttagcaatatcttttaccaaatacatgaccacctttgcttccattatctcacatcttcccttatgatctttttaaaattattgctggaatagaattctgaaaagtcacccacacttaaatgatagtttaattgaattcaaaattattttccctagattttaaaaaataatgcttcgtgtcttcttatatccagtggagcccaaatgagttggatgtaaatttgacttccatttcttcataagcattttccctgaatatgtttagaaatttctccttgttcccaaattttgtcactgtgaatctaggtgagggtccttctcatcctgtatgctcagaatttaataggaccttgcaatctaaggatgtatgtatgcatttagatcctgtgaaatatcctccttttattcctttattttctcatgactatggttgcatactacacaatagtaggttgtacactacacattggcaaatcttactattcaaatgacagcccctgaaattgtgcagtgcacaatcagcaaatcttatttggtagatctgtattttatttcttacttgttctcaattctcccctcctctctaactcctcatcctgttacatgagtttggaacatctggatctatttttcatatcatttaacttttctttcatctctgcatgcatctttttatatggctttgtggaggaatttctggcttatcttgatcatcatgaggagggagaaactcaaactatgtgtttcctgtgctttcacactacaacaatcaacacagaagactgacggcggagcggggttctccacacagcaagcaagcaatcagttctgcagtggacaccagctgagtgtactccaattcagtttttacactatttatcaggagatcccacaggttgaggactgagtctaccagactgcccccacttcaaatgccagttccaagtctgggcctccagaacttctgaccaaccatttccaagctggggttcccatggcttcctcctttgcattgtattaatttgctagagcagttcatgaaactcagagaaacacttgggtttactggtttataacaaaaaatacagatgaaaagatgcataaggcaaagtatgggggaaggagcatggagcttccatgcacctccactgggtgcgccacccttcaggaacctctacatgttcagctatccagaagctctccaagccctgtccttttgggtcgttatggaggctccattgcaaaggaatcactgattaaaccattggccattggtgatcggcttaaccttcagcccctctcccctccccggaagttggaggtgggctgaaagtcccaactctctaatcctccccttgttctttctggtcaccagcccccatcctgaagctacctaggggctgccagacatcagtcaactcattaataaacaaaacgacatcacactttggtgtttctaaggattttaggagttgtatgtcaggaaatggggttgaagaccaaatatatatttcataatagcacaatctttcagcttatttattttctcttggctttatctatcctgttctggatttatcccttgttgaatttttatgtcaataatcaaattttaaatttccaagatgtgggagcgcccagttacttggcacattttcctgcctccttgaaccaaatgaccgcactcactgctggggtcaaagatgtcagtcaccagccagacatggtggttcacacctgtaaacccagaactttgggaggccaaggtcggtggatcccttgagcccaggagtttgagactagcctgggcaaaatggtgaaaccccatctctacaaaaaatacaaaaattagctggttgtggtggtacctgcctgtggtcctgactactggggaggctgaggtgggaggagagcttgagcccaggaggttggggctgcagtgagttgagatcgtgccactgcactccagcatgggtacctgaactgtcatcctatcagttgccccaagaccaacttttgtctcctggttccaaaacatgtggatcattttttggtccactcctgtcttctgcagaagtcctccttggcactcttcactgttaccccatctgccatctttgtcaattttttatcatttctaggaatttggggtggaatatgagaagaaagcaacatatcttcaggacacaatcttgaatcagtagctatttttcacctgtgcattagagacgggaaacttgcagagcacttaacaggacttccctacgatcaccaactagtatttattgaattgtttattagtaggaaacattaagcaattatccttcataaaaacattatgaagtaagtaagcattactatagtcccagttttaagatgagaaaacacagattaaaaacatcctaaagagcagagccaagttacactccaggtggtccgtctcagaagcctgaactctttactaatacactatacgatggcatatccgggtgattttgggaacacattatacttctaccctgccaggagggccaaatgtatttactttgtcatctctgtgctgtaaggggccacatttctacccatcaactcaatctacattactcaagcatgcttgtaattcatatgttatttcctcatgccaggaagaacagtcacagttctgtttcactatgcttttatctttgagactcaaattcccccctccccactataaattatttgcacatactagtctagaaaaatttaatatgccactttcccccacaaacacatctccacaatcataaacatcatgaaataaacttctcttagacaaatgaaaaagtttcttacctttttctccaggctaaggatcaaaattcaagttttacttggttaactctcctgctaatctgaaaactgtcttcttctctatagatgcttgctgtttcaggggggcaggcgggagttatttaagaataatttccattacctaataccttgatactaatgtgaaaaaaattatgaaaatcagaggtcaacacttaaaaagatccacgaaaaatctcctacaaagacacttaaataagtaaaatcatcaaattttcataatgtaacagggagaagattgaagaaaccaaaaaaagcaagtatgttcctttgctggaactaattctatggctaatatatatacaagttaatcagcatacctttctcctgctcattattctacatataatatgggtcttaagtaagtaaacattccaaactagatgaaatacagttccagagagaaattataagtagtttaagacttaaccctttgtattagtcagagttctccagagggacaaaactaataggggagacatatatctatagatatagatagatgataatagattagatatagatatattaaaaggagtttattaaggagaattggctcacatgattacaaggcaaagtcctacagtgggccgtctgcaagctgaggaagaaagaagccagtagtggttcagtctgagtccaaaagcctcaagagtaggaaagcccatagtgcagccttcagtctgtggcctaaggcccaaaagccccaggcaagccactggtgttaagtccaagagtccaaaggccaaagaacctggagtctgatgtccaaaggcaggaggaatggatggaggcatccagcacaggagagggatgaaagccagaactctgcaagccagcttagcccgcccaccttctctctcctgttttgttgtagctaccctggcagccgactggatggtgtcaacccccattgagggtgagtcttcctctcctagtccactgactcaaatgttaatctcctctggcaacaccctcacagacacacccagaaacaatacttagctatctaggcatcctttaatcctatcaagttgacacctaatattaaccatcacaccttaggatttagaattttcttaagaacactgaatgacccttgcccaggatcgtatctgtgctgtgtctgaagtcttagactccctcctggcctaaagaattttccttcaatgcaatgaaaaatgataatcccacaaactagaaaccaagacttgtgcaaaatcaaaacattgcaaaggtgggtgtggggaaatcaagctattatctttaggtatattctattcctaggtgtttaaaacactaatattaaaaagtgatatggagcttcacctaccctctggcaatttgcagttattgtcctttgatcatgtaaagcaactgagatcatttgctcctgacttcacttcactaatctatatccttcattttttgctccaagtgttccttcttctgagtgcctagtgctgctccagtacctagatatctctctctccccctctctttctgtctcaatatccaatcaatcccaagctgtattacctctttaccaactttgggaaagtggaccagtatccaggcttggataagccaaggaaaaatactaaggaactgcttaaagctctagtagttcttctactttgctgtttctggctttggccatctaaagcaaagttccttggattggttgacagtgagatagtctctagattcttgtgtctctttttagtagggccacctaagatgtatcatccattgtgtaatgagttcttgaccaaagaaaagaaatcttaaggtcttccgactctgtcatctttcttgtttgccactctttggactgtaatttgaagagaaaaaaccttgttttcttgtgaaaattttggatgctgagtagttgacaacaacagtaacttcagctagaaaatgctggaaacaatttaatacgcagaaatgattaactccgaaatcatcaacatgactccaccagccccatttttaaatttctatttaaacatttcccaaattatttgcacattcttcttttggctgtaagtcttgtttttctctatgctagctaatagttttctagataatttctattcccttgacttgttcttatgttaaatcctcaaaattaagagctttcaactcaaaaatcagaaataggaaagaagtgtttaatgaaatgatttcacttttttctgaaagtattgacatgaagtattaaaagcatcatctgatagaaaaagaaggtacttgccaaatgttatatcggcctttatagagcactagtaacagacactataaagtcttttgtttcctaatttattattttcctaatgggccacatagcagacactgaaggttctacgtaacaaaggtcctacaagtaaattgtgaaaatcccttattggatggtgtttttagaatacagaaggtcctatttccttaatgcaagatgcttagggaagtcactctcaagtcactagaaatctattaaagcaccacttgctggaaaatggaatgtgctctggaagtacaatggtgctcttgctagcgccttcctaaccataacaataataagaacactgatcaaatatttaccatgttccagccactgtactaagtgctttgggtacattacctcatttaatcttcatatcaagcctagaaggtagtttccattattttttccaccttacaggggaataacttgaggatcaatttgctgtaaggaagtttatttatcacaacaagtaaagaaagttttccaaggtcatacagtccttacgtggggaagctatactcaaagctgatgttcatcgccactacaggctagtgccttctcagcaagaactactcttacagtgctaagaggagaaatgggcaaggtggtaagagccagaatatctgttgttgatattacagatacagctctgaacttaagaccctaaaaatgatctccaacctcagttgcctctgagagacttcagcatgatatgtgatcatgtgagagccacgttatgtgtattctttttaccacctcttctgtattcatctggagatagttctcttttctgttttttctagaggaaaaaaacaacgacaaaaaaacagggagatcttagcagaaccaaagcagattagatattagccttgaaaatggtgacagcaatcagtgatattgaacctgaaataatttaaataattatcggggacttaccagagctaagttcgtggaccactgggatttctcttatttgggtctcatagtcttccataaagtgatgggactataattgtccatcttcaagtatccttctatgactcatgtataatcccttgactcttttaggagattcctggcagttaatgtcaatactgtccttcataatgcttctgagttagcttaggtaaggtccttaaatacccaatgacttatactctgaggcttctaaactggtatgtggaactcggtggttgcaacttcacccaaatcctcattctgtgttgtgctgtccctaatttagagggcaaaagatttcaaactcaatcatttcttgttaaattcaactcttggagctccacctgtcataaacacaatcgcatttcccatgtactcaattacttctgtttctcgaatccatcattcatcccatagatattgagtgcctaatgtattccagatatagttctacataataaggatagagcagtgtatgaaacaaagcacctaccttcataggacttattctgaggaggtaggaggggagacaaatgatataataacttagactatatctgagtaatacaacaaataagtctttaaaaacagtggcttgaataagatacaagtttatttatctttcatgtaacagtccagggctaacagagcagttctgccatcctcatcacagggcttctgcctctgggtccaaagtagttgccccaattcctgccatcacatctgcaccccagccagtggagagggtaagagggcaagggtaacacatacatattcttttttagggcacaaactagaaataatacatgcaacttccattcacatctcattggccccaaactttggacaaacccagatgcaagagaagctggtaaattagcctttaattgagaagccaagcgcccagaaagcagggagttagagtatacaaggaaagatcatttttatggatatcagtctcattcagaaataaacaaataaataaatacattagtattcagatggtatatggagaaaaattaagaaaattatgagaggccgggcgcactggctcacacctataatcccagcactttgggaggccgaggtgggtggatcacaaggtcaggagatcgagaccatcctaacacagtgaaaccccatctctactaaaaatacaaaaaattagctgggtgtggtggcacttgcctgtagtcccagctactcgggaggctgaggcaggagaatcgcttgaacccgggaggtggaggttgcagtgagccgagattgcaccactgcactccagcctggacaacagagcgagacgcgagactccatcccccccccaaaaaaaaagttacgagataaggaataccaagaagtgaggaaaggaaaggaggggagcttgttatcttacctaagatgttcagggaagacctcaatgacagttggtaaagtaacttctgagcaaaagcttacaagaaattaggaagccagtcatgcaaatatctagggatgagcctttgagaaaaggaaatagcaagtgaaaacatcctgagatagaagggccttgatgtattcaaggaagtacaaggagaaaattatgatgaaatggagcaaaacaggtaagagagagggtcagagaagtgaatgtgggccttgatgctgaagccattggagggttttctgttgaggaggagtatgggaatgatatgatctgacttatgtttcaaaaagtgtactctagctgctttgtgggaaatataggagggagagagcagaatcaaggaggccatttaaaatgccattgcaaatatccaagagaggtggaagcttggagcagggaaacagtggtggaggtggtgagatgtggttggatgctggacatattttgagccaagaggattttctgataaattgcatttggaaaataagaaaaagcttattcactcaccactctaacagtcacaccagtctataatcccagcactttgggaagccaaggcaggtggatcaattgaatccaggagttcaagaccaacctgagcaacatagtgagaccccatctctacaaaaaaaaaaactctaaaaattagccaagcatgtggcatgcacctgtagtcccagctactcaggaggctgaggtgggatgatcacttgagcctgggaggtcaaggctgtaatgaactgtaatcatgccactgcactccagactgggtgacagagcaagaccctgtctgggaaaagaaaaaggcatggcggggggtgggggggcgggtgtggtgtttcacacctgtaatcccagcactttgggaggccgaggcaggcagatcacctgaggttgggagttcgagaccagcctggccaacatggtgtaaccccatttctacaaaaatacaaaattagctgggcatgatggctggcatctgtaatcccagctactcggggggctgaggcaggagaatcgcttgaacccgagaggcaaaggatgcagtgagccgagattgtgccactgcactccagcctaggtgacagagcaagactccatcttgaaagaaagaaaaagaaagaaagagagagagagaaagagagaaaagaaagaataatcacaccccaagaacatcaagctaggaccatggtgaacaatgctccaagagtgttctgatgctgtaaactgagtgtgatgtgcataaattgttttgcactctgcaggtaggagggtgggatagccaaagctgttcaatataataatattaaaaaataaaatatcaattgaagtaaaatacaaattttcttaagcaatattttaaagtaaatggaaatgttacaacctggatgaggggtgaggaattaataacctctaatcacagaataaaaatggaatgagaattccatctacccaaatcagacaattaaaaagtcgaaagaggttacagtaaaaattgggtaaaactaaaacttaaaaaataatttcagaggatacatgatatactcgtcacacagaaaactccagttgaaccttatggacttgaggaatggatacctttgtttctccatcacttagcacagtagctggcaccatgtaagttctcacagaattttcctgaactctccaaccagaggcaacctttcactctccattcacataacatttccttctttctcttcttttgggaataatgtatcttgcttgaattatatttatctttatgccagtttaattctctcttttagattcatttacatctttgtatcctctagctcattattttttcaaaataaaatggattaacataaacaattattaaagagataaactaaaggaaaatattacaacctggctgaggggcaaaaattatatgttcaacatatatttgataacacatactgagaaaacacggtctacttttacttttcagaagtttgttcatgttgacattgtggggcctagaagatttttatcaagttttctatttttgccaagtcatatgatctgctatagttcagctatagttaaccaaatgtagaaaagaaaaaaattttccataatatctagtaattctccaaaacaagcttgttccttgttataaacactgacattctttgataactctcactttatcccacagaggtcatgtacttatttcccatctgttgtcctatgcttacattccaaattcagttgcattgacttttagaacagctttaggaactgcacccagttttaaaatacattatttgtctaaaaattatgacatgagattaaactgtcatctttgtaggtttctacacatactccaactcattcaccaatccttgaaaagattatgtaaccaatctcaatgccctgacccaggccaagcccatttctacatgtgcagtgttctctggatctgatatttaaagccccttatcctgatactacacaccttttgtcttctggaatgcacctctcttctcatcctttttcaaggcactagaaaagcagaccatttctgcagcacctcaaaccagggtgagaaagctccactctaatctcatcattttagctacatagatacatcggctcaagggaagatgccaagtgtagtactttaccactctgaggatttttgaatctataacagttgtttcaactgggccaataattatgaagggcaataattaaaaagagtatccatagtaaaggagtaagaaaaaaagttagaaaaaaagtagagaaaaatatttactagagtatttactagaacccaccactctcagatcaattttctagtgttctgttgactggcaaccagtcaacaaactttcattgagaagctattttatagtaggcattgggatagcctttgtggaataaataccgagaagcatatgtctctagcagaagacagacaagaaaatgtaaaaacaagaaaaagaaattgaggaataagcctacagtttacaaagctacacaattattcgttatgcaaggaatgaggacttaagagaaagacttccctgtgaactacaatgagatgaaaaagcttctcagagtgagatttgagcaagagtttaaaagaactgacagactgataaaaagcttcaagtagtccagaggactgagtactaaaactcagaacaatgtaacaaaagcacagaagacaaagttaagatgctttacatgacagtagaacatttaggctaagctggaggactggggagaacaagtgaagaaggtaagttttggctagataataggtggcctttagtgtcaggatgaggatttggaagttaatcttttggtcagtgggtaataaatgatggcatttgtgtagttgagccagttgacaatgctttaacaacttcaaaaggccctgaaaaacatggtccctaatccttaagaaaaaaggaactcctgacttcaggaccctaagctaggaggagattggaaaaattctcttatggcccaactgtatagaaaatagaccacctcggccgtctcacttactgagtaacctttcctaccagagaatgtgctatatatgatttctttactttcaacggaaattttggattctcagttatctttccctgacctcttgtctggtgatcagaaaaagatgactaaactgggaatctttattttctagtggaaaaataatcacgtataccacattttatatcttttaattgggtgtaaatttgaacttcaacatcataaaaattagtaaaattcattttaagcacaaagttgttaattcccccaagatttatcaagaatggcttaatttcaaaggctgtcaagttaattataagctaagattttccagttgcaccaagggtatattttatttggcaaaagaaacatccactggcttttgtcaggatgagtcttgagttattcaagttttgaactgagaggtcttcagaaattcaccccacatattaactgtggccttctctacaccacaaattcccctccactcatcctcaaattgtttcctttctcagaacatctgtgacacaaagactgtgacacacccacaggtcgattaacatgaggacccaacacctattaaaacatccacactcctgagaacactaaaaaccaaccacctcgtcaggtcccacctccagtctcgctgaatcaggaaacctcaagagaagcacctggaagcaggtttaacaagcgcaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcggacgcctgtagtcccagctacttgggaggctgaggcaggagaatggcgtgaacccgggaggcggagcttgcagtgagccgagatcccgccagtgcactccggcctgggcgacagagcgagactccgtctcaaaaaaaaaaaaaaaaacaagcgcaaaggtgactcttataattgggaaagtttggaaccaagacagggttcttgtcctggaggaagtattttcctgtggagaaggacctgtaaacagcctatgaagtgctcagctttcaccaagaaaaacatgggctgatagggttaaggaaaagtttgactgaagaggattaaatcctgaaggttagggatgtctttgggcgctggggtctctcaatcaccaaagatagacattacaggccaggtagctctttgtccccccagaggactgtcctgtgccttatgcttagcactcctggcctctgcccattggatacttctagcacctcccccccaacacacacacacctgacaacccaaaacatctacagatattgccaaatactccacagggggtggggtggtggcaatatatctccctgtttgaagtcactggaatggaagttaggggaggatggctaagtcaggacttgaaaaaaggctaagggacgaaagcacatggctatattagacaaagtttgtgacagacgcctgtaggtatatggtaaggaaaacagattaaaacactaagaaatagtaagaggttggaccgagggtttctcatctgtatgggaaatctcatctcgttcattactttcagaaacaaaaaggaaaacgactttaaagatacaggttaaaggctgaaggggtgtagaaccaccccccgcctccttccctccatccctcccaaatatcccagaacgagtcaaacctttctaatctcgtagcacagataacaagcaactcagtaagactagacggggatgactgagggccaactcattacaggactacaggaaactccttagtcctaaacccgaatgcatccgtgaccatggtaacactccctacctgaccaaaagctatcaaacgctctgacaagtgtttacagctgctttctcgattactgaagtggctctgaaaagagcctttggggttaggtggttgatctattgcgtcccttgcacactcttacttcgagctggtgtacttggtgaccgccttggtgccctcggacacggcgtgcttggccagctcgccgggcagcagcaggcgcacggccgtctggatctcgcgggacgtgatggtggagcgcttgttgtagtgcgccaggcgggacgcctctcccgcgatgcgctcgaagatgtcgttgacgaaggagttcatgatgcccatggtcttggacgagatgccggtgtcggggtggacctgcttcagcacctcctacacgtaaacggagtagctctccttgcggctgcgcttgcgcttctcgccgtccttcttctgcactttcgtaacagcctttttggagcccttcttgggagcaggagcggatttcgctggatccggcatttttgcgcgaaaaaagagaacagagacttaaagaagtaatccgaactaccgcaaaacgggctggttatgcgctacttatagagcctgtatgcaaatgaagactcgcaaagtgctgcgctttaattggttaacttacaacggtgtcgtcagagggggtggagtctatgtaaataatagattctagtcttgcttccttaatggtcactgtaacaaaagtcttgttatccaatcagaatggtccatttcacactaaccagttttaagctaggtgaagcgatagtttcaacggcttgaggtttttttcttggttttcactttccattagacttgcatacggaagaaatcttaacgccagctagacaagttaactctcttgcctcgtttttgcatttttattctatactttgtggaaatttttttctcttccttgaaatactacctcacccacacatttttaaaaatcgccagatatttactcccgcccgcttaaattactattctggcttggacaccgcctgtagtatgcaatgaggaagatgctgagctttaattaagcttatagttcctaaataaaccaggaaacgggtttataatttttaagggactcgccccacccttacactcaggatcttccacatctagaaactccccatagtctcttgcccccatgcaaaactttacccacagaattgggagccggacctctagccttaaaccagcgtgaaaaggctcggccggaaccacaaggaccgtgcctctgcggctttctctactgccggccaactcacggctgggctttgggttctgtaacgtcacccaccacgagtgcccctggcccctgaccgctgcgcaaggcagacgcacatcagatggagagccggtacagctgctcttgatgaaaacggcagtggctctgaaaagagcctttagatcgaccacttaaaaatataccttaggcccgctccccgcggatgcggctgaccaactggatgtccttgggcatgatggtcacgcgcttggcatggatggcgcacaggttcgtgtcttcgaacagccccaccaggtaggcctctctggcctcctgcagcgccatcacggccgagctctggaagcgcaggtccgtcttaaactcctgcgcgatctcgcgtaccagccgctggaagggcagcttgcggatcagcagctccgtagacttctgatagcgccggatctcccgcagagccacggtgccgggccggtagcggtgcggcttcttcaccccgcccgtggccggcgcgctcttgcgggccgctttggtagccagctgcttcctcggggccttgccgccggtcgacttgcgggcagtctgcttagtacgggccatgctgtctcattgatacgagagggtctaggcagtcgtatttatagacatagcctcctcttgattgggcctgaaaaggaaattttcaaacttgtgatctcattggttaaaattcagtcctctttactggggcggaagattgttctgctaatctttcttcccttattatttccccctttcctgatttttttctgtaattttatcgatcacggattgcttttgaagactttcctttaaattagtctaacttttgtaaaagcaatgtataaagtgttttgcatcccattttaacagagatttttttttttccccgaattcaagcatgcccttctatgagctatcagcctgtttcaggttacctgttactgaagctcttctaccatagctaacatttatttcatgtctagcattttgctcagcaagttagatgcattgtataccatgaatgaccgaagcttagcaaaaaaatatgtaattgaaggaatgaaaaaattgatcttatttacttgaccttggaacccagccaaagccatttcatgtggatagtgtgctgacctatattgacctgatattagagcctctgccttcctttagtcttttctccctgcgatgtggttccttcttcctcaccctcacatcaatggccaattaggtcctgcagatgttaagcttctaaatcaaagaaggacaacaccagaaattcatttctcctttacaatgtagaatagtttgtaaattagtgcttattagccagattacaagttaaagtttcaaagcaaattattcatcaattgctgacttgctaacattttattcaataaagtattttataatgcttaaaagtttaatatttttttctgttctctatgaagagagtaaagatgctttgctttttcaatttcatgtgctttgaagaatgtattgttcagaacagtaaatatagtggttatgtagaagcaactgatacttaaaagttgtagtagttaatataaaacttttaatcatatgcttattttactaaaaaaatcattacaaactataaaaactcaaacctgagaaaagcaggcccgaaacgcttaaaacttactttgatggtgtcattatgaactatcttcctactgaagtcaaagtaaagtaaaagtgatttcaaggggacttcctgaacactaaacacaaagtagaaatctgtgagcttaattaatatcttcaagagtctctcatgggcagaagcatcctcctctcgagagatctaaaatgtacaaaagtgtaactgatgtgaacaaatgttatccctctctgtggtagttttgtaataatgccttacagacagcaggcactactcagtgtttaaagttcttctacatacactttatcatttaatccctactctgtgaaatagatcttactcttctcactttacagataagaaaactgagtctcagagaaattatggcttgtcctgggtaagtaacaaagcctgtgtaatattctaaagcaaaagaatgaaacggtaatgatgaaactttctatttcattaggcttagaggataccttttttttttttcatttgagatggagtctcactctgtcacccaggctggagtgcagtggtaggatctctgctcactgcagcctccgcctcctgtgttcaagcaattctcctgtctcagcctcctgagcagctgggactataggcgcaagccaccacccccagctaatttatttatttatttgtatttttagtagagacagggtttcaccatattggtcaggctggtctcgaactcctgacctcaggtgatccaccctcctcggcctcccaaagtgcttgggttacaggcatgagccccacacacccagccaacacagtttaaagcacaaaagcgttttcccatcatgcaatcacatcatctagtatttctcaaacatctacacccaactattcccattagaagggaaaactaccccatggaatctggatgatagcccaaagcagcccacccaagcatcacttttctttgcaatatactttctctatgatgtatgcagtcttgaccataatgtaggatgtgttcatttaaataagaaaatggcattcaatcagactttaatggctataggtatcatttctcagaataaaacaatcagatgtatagttgccttaaaagtcatctttaataacagaattcagatcaattgttagttcaatttcacctagtccccacattggacactagagtgacatttctgtgaaaggtctcaatccaccactatatcagaagcagctttatggtgcaaaagaagctctgcttttcttcagttgtaacaaagacggaatattcctcctaaaatttttgaagtgtccttcagcagaaattataaggctgtgcagcttgaatactgagaacagaaatttcattaggtagcacgggggaatagacaagagaagattaaaatttacctaacaagaaataagcaggcaaaagaaaatattaataaatgaattattaggcacataatgttttgtatgtacatgtgtttacttttaatacaaaagtaacggactaagttaacatagatgttccaataagataatttatgtttcattttttggcttcaagtatcctcagggttataagtatcataagctgagaccggctgaattggtttgtgggttgatgaagccctatgcctgatttgaatttctcttgaatggtctgcagccctggaccaagttgaagaagccatgagagtctcagcttttttccttaccccattatgagataaactcattccttaaatatcttgctcatttgataaaacttggcacccttctcctttctactggtccctgatacttactacctgtactgtaagctcaaattttttacaatttctgcctttattatgtaacgtattccactggaatatgtgttacaggaaaggggtcccgatccagacccctagagagggttcttggatatccggcaagaaggaattcagggccagtccataaagtgaaaacaagtttactaggaaagtagaggaataaaagaatgactactccatagagagaacagccctgagggcttctggttgcccatttttatggttatttcttgattatatgttaaacaggggtgggggaggtggaccacgcctataatcccagctactccagaggctgagacaagatcatttgaacccgggaggcagaggttgcagtgagctgacatcgctccactgcactccagcctggaccacagagggagaatccgtcccccgcaccccacccccccaaaaaaaatcactgccagtaaggaacaaacagccaagacgaagaagtactaagatgtaaagagatgtaaaataggccgggcgcggtggctcacgcctgtaatcccagctctttgggaggcctaggccggcagatcacgaggtcagaagatagagacgatcctggctaacacggtgaaaccccgtctccactgaaaatatttttttaaaaaaaattagccgggcgtggtggcgggcgcctgtagtcccagctactcgggaggctgaggcaagagaatggcattaacctgggaggcggagcttcaagtgagcccaggtcgcgccactgcactccagcctgggtgacagtacgagactctgcctcaaaaagaaagaaagatgtaaaatactgtgatacattctgcaagagttatgacagagtcagaaaggggcaagcgtgtttcttctctaccctgaagcagccaagggagaagaaggtatctgttgccaacgctggggtgttacaagtgcacactgtcatgcccggctaattttttggattctagtagagacaaggtttcactgtgttgcccaggctggtctcgaactcctgagctcaggcaatccacccgcctaggcctcgcaaagtgctaggattacaggcgtgagccaccacgcccggcctatatatgcatatttttttctaacacttacatactttttcttggtgccaagaatgttttaaacactttacatgtattaactcattttatcctcacaaaaccctgtcaagtaggtagtataagtatgtccatttacagattgggagatggaggaatcacagagaggttaagaaactttctcatagtcacacagtcggtgccaaaccagatttcaactccagagtcttcctttagtcactatactacactactaatatcaaataagtaagatgttgatgcaacattgatagtaatttaaaagattagaaacaaccaagagccggggtgtagtggcccatgcttgtaattccagcatctgggagcccgaggcgggcaagtttgttgggagttggagaccagcctgacaacatggcaaaaccctgtctctacaaaaaatataaaaattagctgggcgtggtggtgcgcgcctgtagtctgagctacttgggaggctgaggtgggaggatcgcatgagcctgggagattgaggctgcagtctgcagtgagttatgatcacaccactgcactccagcctgggcaacagagaccctgtcttaaaaacaaaacaaaaccacctccgacaacgtaggaatgctgaaatgagttatgttaattctaagtaaaaactcaacctatcccaattagcccaagaccactacttagtctacctaagccaagtctgttgacttgttacaatgagggagaacacacaacagagaaactggtggcagggtggtgggaggagggtgctcaccaaacaagaggaaaattagagttatcattgattttgggggacgagtggagtgtagttttcataggctcaaagcaaagcagggctgtgtgaaagggtaggcataggatgggactttgaagtggatccagggtcttgtttcctcagaaactacaaagttgagatagaggtggaatgctgtgttcagaaaccccttacttgaagtttttgcacctgggttgaaaattactgctggttttttgtgtcaaggtggcttaggtcctccagacaggagggggatactgcattgttactgattgataggatttcaagcagccaaagttctgatagtctgtgattttgagtacaagttcctcagtgaataagaaaggagtggtcactcaaagaggggagttatgagcctttatagctgtagcatgcccttgggaaaagaatgttttctgtcatttctagtctagctttatctctgttagtgcagcctaatgaatggcagaacaggttttgattttctcagtcctagcgaatttctgcttctcgaagtgcatgttagtggtaatgtgttttatatcttactttatttcttattttccccccctttaatctatattttattttatttattttttatttttttgagacggactctcgctctgtccccagggtggagtgcagtggtgtgatctcagctcactgcaacctctgtctcccgggttcaagcgattctcctgcctcattttcctgcctcagcctcctgagtagctgggactataggcgcgcgccactacgcctggctaatttttgtatttttagtagagacgaggtttcaccatgttggccaggctggtcttgatctcctgacctcgtaatctgccggcctcggccttcccaagtgctgggattacaggcatgagacaccgcgcctggcctaatctatattttaaaaattgaactcttccatgtacccctgaacctaaaataaaagttaaaaacgaacaaacatacaaaacaacaacaacgacaaaaaaaaaaaaaaaaaaacaaaaaaccaggccgggcatcgtggctcacgcttgtaatcccagcactttggaaggccgaggcgcgcagatcacgaggtcaggagttcgagaccagcttgactaacatggtgaaaccctgtctctactaaaactacaaaaattagccgggcgtggtggcacgtgcctgtaatcccagctacccaggaggctgaggcaggagaatcccttgaaccagggaggcggaggttgcagtgagccgagatcatcccactgcactccagcctgggagacagagcgagactctgtctcaaaaaaaaaaaaaagagagaattctgtactttgtaattagaggggtaattcattaattcatgtcaggggcatattattttatttttccaaatgctaggaagcaggtatccatttttgataatataaattttgggataattggcagtcatctggctcacagggaaaacaggaaaaacaagaaacctaaataaacttcatattgatttcccaaaaaaattaccttttattttcaacccttatagaacccaacctgcatctctttgccatccatgttctttttttttagagactgggtctcattctgtcccctaggctggagtgcagtggcatgatcatagctcactgcagcctcaatctcccaggctcaagtgatcctcccacttcagcctcccaagcaattgggaccacaggcgcatgccactgtgcctggctaatattttatttttttgtagagatgaggtcaatctgcattaaacttcatgttgctccaacaccacattttatctccccactttcccagcaatggacaactaggcttgtgccaattctccatcaccaccagaaatgctgcaatgaacattgttgtatatattcccttttggacctatataagaatttcttttggataaaaactcaggaacagaactgctgagaagccagaaaccagcagttctgttcagagtttttatttatatctaattgaactaaggagtgtcagcctcccctccagaatgcttgtcccggacttccaataccaaggtagctggactctgagcccacatccaggcccaatcctcgggtcatccaactttctaagttttgccagactgcctggtgtaaagtggtatctcagcattgctttcgttttcattgttctgggtattcatgagttcaagcatctctacctgagcttgatagttttcggatttcttctcctgtgtattgcctgttcatatcctttgctccaacattgtttatagagcactccctccctactttggcatttggggtcccctaaaccggcccccattgctaaagcttacttctcatgactgacctttgcctatgctgcatgtggtccaggaacaattcttctgtctttgtttttgctgtcccctcttgcctggattacatcatcttctccaaacccccaatctaaacatgtcccgaatcctaaatattctttagaaccaagctcagatatcacctcctcctggaagggttcctttatttgctcagctggccttggcctttccctcttggctcccacaaagctcaacctgcatgtattatttatttatttatttatttatttattatttttttgagacgaagtcttgctcttgtccccgaggctggagtgcaatggcacgatcttggctcactgcaaagtccgcctcccgggttcaagtgattctcctgcctcagcctcccgagtagctgggattacaggtgcctgccaccatgccagactactttttgtatttttagtagagacggggtttcaccatgttggccagactggtctcaaactcctgacctcaggggatccgccccccttggcctcccgaagtgctgggattacaggcgtgagcgaccgcaccaggcctcaacctacatttcaagtcaccatctgtcacaggataccttccactctggctctggatatgggggtcacctcctcacaaagacagacaggttgtatgtgcatacacagaaagattcagaagaaatatgaagacttttaaaatcagtcggatgattttaactttcttctttgtagttttctctagccagttttaaaaactgtaaattgtaggccgggcgcggtcactcacacctgtaatcccagcactttgggaggcggaggcgggtggattacctgaggtcaggagttcaagaccagcctggccaatatgatgaaaccctgtctctaccaaaaaatacaaaaattggccaggggtggtgccgcatgcctgtagtcccagatactcaggaggctgatgcaggagaatcccttgaacccagaaggcagagcttgcagtgagctgagattgcgccactgcactccagcctgggcgatagagcgagactccatctcaaaaaaaaaaaaaaaaaaaaaaaaaaatccagaaaaacaaaaacaaaaaaacctcccaaaaaaccacaactataagttgtaatccatagtgcaattaatttacttggtagagatcatcttttcctttcattttgcccttttgtaagaatcataaaacgggaaaatatcaccaatagtaattatcattttgtgaaacttgttgcaatttttattttcctgtgaatgtgactgggaggcaatgtaaatgtatttcttttttcttgtttttgagacggagtctcactctgtcgcccaggctggagtgcagtggcagatcttggctcactgcaagctccacctcccgggttcacgccattctcctgcctcagcctcccgagtagctgggactacaggcgcccgccacccatgcctggctacttttttttatttttattttttgtatttttagtagagacgggttttcaccgtgttaaccaggatggtctcgatctcctgacctcgtgatctgcccgcctcggcctcccaaaatgctgggattataggcatgagccccagcgcccggccaatgtaaatgtatttcttactgtagacttgaggtcaggagagtgggctgtactgtacacatattgatattatttgtatctattccatgtatcactttctcctaaagcatcaaatctaatacaaaaaaagaaaagcaaaacacaaaacctaggctcaaattccaccttggccatgttttagccgagtaactcacgttccccggtgtctaatctttaccagaaacttccttatctttaaaatagggaaaaagccttttcttctttccagggttgttgtggactcaaacgagaggctgttagtgaaaggtttttgtgagttataaagctcctaggaacccaattatttctgctgccttggccacatagtctagaagaatctctacataattagcatctagagactggataatttacccattattttccatgtgcttgtcttatttcccagcatgatggtaatatttccaagggaaagatctaggatatatatcaagtaacgtttatcataaaaataatgaaattgctaataactattaatttattgtcatgttgagactctgctctaagtactttgtatggactgtatagcaatttatccctgcacgaatcctatgaggtatgtgtatttattgttactgttttacagatattgaaactaagacactgagcctctattttagcctcatgtcttctttccttccagcttttcccaggcaagtaaatgcaggccacagtctgccagctgcccaaccattcaggcttttcattattataggaagcatctggccaaggaccaccaacatcttcctgtcctgcccctgaagctgtgagttccccaagtggagacacagcctgttccccaacacctacactcatgaacacgggagggttggtcaaaattgcaccgctatcatgcttagttttatactcaggtgtaagtgactgatagaagggccttttggaggtggagagtgcgcaggttctgaagaggcaagaccggggaagtctggacctgcttccagagtgtcctcccacaaggcttagtgctcaggacctgtagtgggttgaatatgttccctaaagttcgtgtctatccagcatctcaaaatgtgaacgcatttggaaactggggctttgaagacgtaagtagttaaggatcttgagatgaaatcatgctggatataggatgggccttaaattcaatgactggtatctttataagagaaaggagagggaaattcggacacacagagatgagtaagaagccatgtgaagatggagggagagattggaatgaggctgccacaagccaaggaacatcagaagccaccagaagctgaaagaagcaaggaaggattctccctgagagcctttagagggagcatggtactttatttcagacttctggtctccagaactgtggaagaatacagttctgttgttttaagctaccaagtttgtggtcatttgctatggcagccctaggaaacgaacacaggttgagtatcccttatctgaaatgcttgggactgggactgtttcgggtttcagattttggaatatttgcatatatataatgagatatattggggatgggacccaagactaaacacaaaatccatctatgtttcataaataccttatacacacttacactgtgccccattttctccaacaacttgactttctgtactatagataaacataaatgttttctctcccttttttttttttttttttcttttgagacagagtcttgctctgtcgcccaggctggagtgcaatggcacaatctcgggtcactgcaacctcctggattcaagtgagtcttctgcctcagcctcccgagtagctgggactacaggcatgtgccaccacgcctggctaatttttgtatttttagtagagacggggtttcaccatgttggttaggctggtcttgaactcctgacctcaagtgatccagccgcctcggcctcccaaattgccgggatttcaggcatgagccaccgcgcctggccttgctttttctcttttaaaatcactgttactcatggggtatctgcaggcctttttgatattttcttttttttttttttttttgagacggagtctcgctctgtcacccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaacctttttgatattttcaacaatatctttataccacagagcagagaataagcaaaaaaaccccacagtgagtaaggcacgtaggtcttggctcctacatggggcattatggggaacgtgctgttgacgacactggcctgcacacatgccattttatgaccctttgtgggtgtgtgcacgttggggaaaccgggcatgtgcagaaaagatatatctcagcggaaaggggctgggagggccttttatttccttgggggaaatactgtgcattgtatgacccgttgtgtgaggtcaggtgtggaattttccaccgaggcaccacattagtgctcaaaattgttcagattttggagcctagggtttcggatcttcagattaggggtgctcaacctgtacaacatccttgcaacaatctaggtgtgagctttcctcaagagcaagaagagcttgccacttctgctatatgaccacggtgaagccagcctgtcaccctcctgccctggatgaccccagggagctctacagaggtccatggctgggggaggccagcaattgtctaggagagctcagtgccacttgcaaagacgacagatctctctacaaattctgggctgagcaggtgaaggaggctggtcaggcccatgaaggagcctagtcagccgtaaggaaaggttcactgtggggcccccgacttcccattcctgatctcctttgtacctctgctgcccacttcctttcctctttccctccaagtataccttatactctgctcctgatgacactcagatctccccccgcccccccgcccctgtcaaataaaaagagcctagtgacttttgtaagaacggtgtattcatttcctagtgttgcattaataagttaccataaacttagtggtttaaaacaacacaaatttgccgggtgtggtggctcatgcctgtaatcccagcactttgggaggccaaggcgggtggatcacctgaggtcaggagttcgagaccagcctgaccaacatggtgaaaacccgtctctactaaaaacacaaaaattagtcgggtgtggtgacgcgtgcctgtaatcccagctactcaggaagctaaggcgggagaattgcttgaacctgggaggcagaggatgcagtgagccgacatcacgccattgcactccagactgggcaacaagagcgaaactctgtctcaaaaaaaaaaaaaaaacatgaaaccaaacaaaacgaaaaaaaccacacaaatttattctcttatcattctggaggtcagaagcccaacataagttttaaggggctaaaacaaatgtctgaaggactggtttgttctggaggctccaggtatataatccactttttgactcttccagcttctagaaactggcattttttagcacctggacagatcactctaatgtctgcttctgtcatcacacccccttctccctgattgaccctctcgtctctctaaggattcatgtgattatattaagggctcatctcaataatccaggataagttctttatctcaaggtccttaatttgttcacatttgcaaagtccctttgccatataaggtaacatattcacagagtccaaggattgggatgtggatatctctgtggggctattattcagtctaccacaaatgtgcactcctttctaaagtatttatcttcgagcactgaggggaactctgccttcagctaaggctacacaactatcctgatggtggactgtagcaacttgtaggcaaggggtacagctcagggcagctacctctccttcttctcgggccaacctggaggaagttccttccagagtccaggctatacttgcttctggcctgcaaattcctgagaattctttgaaacctaggaggggcctgggtattatgcccttttgagtgagaattcagaggccagtggaattagggcaatcaggcatttcctgatcatctgctatgctccaggatgctgacttggagagatgaacaaggcaaaatgctcattctgacggcactcagaatttcacggggaactggaaggataaatgaatctgggaggaactgctaaaacaggtaggagagggtaagcttgttagaacctgagcagaatgctgtctgaaaaggtagagaagtcaggagaagcagtgaggccctcaaccctgtgtgtcacaatgcctcctgtcatttcctctctgagtttccagtacaagcttctcggtggctgttttctgcccaagcacatgaactttggaagacctagcactttggacaaagtccctggccctgacacttaatagtttggggaacttgggcaaaatactcaaagcttcctagtctgtaaagtgagaatgacaaaacatctgccttccttgcaggattgttgtggtgatgtgtaagacataaaatatcaagcatagtcagcagtcactgagcttaaggaatgttaagttataatcattatttctgaacttcagtgcccaatatgaccctgttgacacctcctttgcctccttgggacatactctcttctggtggtcctcatccctttccagctatcctctgtctcttggtattctcctaatctaccaactcccatcaatgttcctgcttgcccagggtgcctgtctcagtcctcttcttttctccctaacccctgggaagatctcatcaaattccctgcctctcgttttccttatcgatttgctgagggcttactcacaagtttctccagctgagaccctttactgatgagagtaataacaactggtggaagtgttctcctaggtagagaacaggaatctcaatttttaatgttgggagggactttatgcatctttttgctttcaaaagcaatttctgcctgggcgtggtggctgatgcctgtaatcccagcactttgggaggccgaggtgggtgaataacttgaagtcaggagttcgagaccagcccagccaacatggtgaaaccccgtctctactaaaaatacaaaaaattagctgggtgtggtggcaggtgcctatgatcccagctacttgggaggctgaggcaggagaattgcttgaacctgagaggcggaggttgcagtgagcagagatctcgccactgcactccagcctgggcaactgagagagactctctcaaaaaaacaaaaacaaaaataaaagcaatttcttctctctgcattctccatgttactgaaacctaacatcaaccccatagctcctcaggccagaagctcctttattgcatgcattctccaaatgcctaaatcaccaatttttttttctttctttctttttttttttttgatacggagtcttgctctgttgcctaggctggagtgcagtggtgcgatctcagctcactgcaagcaactcctcccgggttcacgccattctcctgcctcagcctcctgagtagctgggactagaggcgcccgccaccatgcccggctaatttttttttttttttttttctttttttttagtagagacggggtttcgccatgttagccaggatggtctcgatctcctgacctcatgatccgcctgccttgtcctcccaaagtgctgggattacaggtgtgagccaccgtgcccagccttttttttttttttttttttttcgagacggagtctccctctattgcccaggctggagtgctggagtgcaatggcgcaatctcagctcactgcaacctccgcctcccgggttcaagcaattcttctgcctcagcctcccgagtagctgggactacaggcgtgtgccaccacacccagctaatttttttgtatttttagtagagacagggtttcaccatgttggccaggcttgtctctaatttctgacctcatgatgcgcccaccttggcctcccaaagtgctagaattacaggcgtgagcctctgcgcccagcctgtttcttaaaattaatatgtcttattgcatatgtgaggtcaaggtgtcatactgtctcatcatttccacctcctctttcacaattcccattctccattttattaaaaatgaatgaatgaataaatgattatcacatgtttaaggcttcctgaatttaattatggggcattccattggggtgtaattacctgcagcataatattgtagaacaactcaatatatggaagcctcctttagtcaagaaattgtaatcctacactaaggctacatgtttttgtctttatatttttgataagggtgcagcataatatagaaacaaggtatttggggacatcctgaattcatgtacattgaggagtgaagtggcaggagttatggcaaattttgttgaagggtcttgccttttgcattgcctaattatgatcaaataatgcattgctactataggagagttctgagagggcaaagtagagaggctcagtacaaaatacagaacttatcagagctcattccatcctggagacaaacttatgacaagactctgtgccttatccacctccctgcctcctttccttcctgtctttttatccatcttagaattaagatatttaaattttgtctgaagcatgtcagagaataacaacatgctataaaatttcacttgtgttcacccatgtgtcagctgagtattttgcattgttacatttttattttactgtattttattttattttttttttgaaatggggtctagctatgttgcaaactcctggcctcaaactcctgggcgcaagcaatcctcctgccttagcctcccaaaatgctaggattacaggtgtgagccactatgccctgcctattttgcattacttcaaagagaaggtgaggtcacacatttacttccaacagatcaacattatatcttcaagttagcaaaagcaattgaaagtaggtagtggcattctatatttccataaatgctcctttagacttgtaaaaaaattatcattaattttggccaaaagcttattgatgtcataaaaccatactcagtttttacttggacacattctcctgctgttcctcatcaaccactttgtgggtttagtcattcaaagtatgtacttactagatttagattaattcaatggagatatgttgtgaattcaactgaaaataatgcacttaaataataattactgtatcttttgtaatcagcacacttaccagagcttcaacacctgcctttccttttgctatttatttccacaagatagattaaactacatttttaacagtagaacatttacttatgtagaacaaaatgttcctaagctgtaaactactgtgtaatgacctgaacactctagaaagccagcttcattacatttgttttgggagtgcgcacataaaatgttgaaggaccactgtattaaaaggctattagcataatctctaggagacacaaccagaaaaccaagcatagaggctgagcagccagaaccaatactgctaccgctgtccctgccactcaacacaggccaaatagtgggcagggatgctatgccaagcccctgccttgattctctctggaaactggatgtatctttgctgcctctctgctgtcacctgaatggattccctcaggaccccgtcttcatgacttcagtcttccacactgaaatcacatgcaggagcactgattggtggagtctgtgccacaatttttcctcacttcaagggaatctgggaaaatttggcctctattttcaaaaggcagactcactagatgggagagtcccaaatataaagagtattcaaagcaactagagagcttagaaaaaaaaaaagaatgacaaatgctatcacacaaagtatataataacatatgattttaaaaacaaatattttctttaattcattacatgatcgaggattgcatttatgatgttcattttactctaatgctttactataacactgagccagttttatgtttctccccattcaaaaaatgatgcatgctcctcaaatttactttaaattaattgcatgaaaaaggatgattagtcaataaataagtcttgaaaagacatattctatagtgttcggtttggggttttcagattaaaatacacattgaaatttactacatgatataacaagaaaaaaactactttcaaggcctgatatttgattcttctatcttgtatttgagaaaccaatgtattttacagatttttacaaaacaaagtagatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaacaaagtagacattaattccacttttaaggatgtaaagcccccagggtaacatggtaaacctgtcacggatcatgacccactggataggaaacactgttttactattctctgggaggtatgtgaatctcaacttcctgttgcttcctgaatctacttgtgacacagtcacaactggagtggcagtagctaatcccggactgtccctgctgcttgagatcatctaatcagtcactcctccacctcatctttgtctgtttgatgttgaaattgtattacatgcttgaactgatcaacaattagatggctagagaccattttgactggctgcctcccagtcctgcaataaaacacaacaaaactgtaaaactatcccaacccaagaaaccagagaactaacccaacccaagaaaccagaggactccctgcgcaagaaatccacactggccctagagtgtcccacgcaggtttgaacagcaaccctggacctgtgccacaaactcaagtgcaaggggactccggtggaccctgtaatggcctatctgatttggcttctcatttacagagaatggagactttacacaccacaatgtattgtttgcttaaaggtgcttagaaagaacaacctgaaaccttttaatcttatttgttcatgtagaaatgaaaccgttgagaccttatcttaatgcatatagtattccagttgtaatcagcaaccttttagttaaaggaaagtaacagccggttgagattgttacttttccttttaccaacccataaaatggagacaagggactagattaaatactaaaacagggaactaatctttcagcagccctataggagttagaagcaaaggctcctgggccgggcatgatggctaatgcttataatcccagcactttgggaggctaagacgggtggatcatttgaggtcaggagttcaagaccagcctggccaacatgatgaaaccccatctctattgaaaatacaaaaaattagccaggcatggtggtgcaggcctgtaattccaactactcgggaggctgaggcaggagaatcgcttgagcctgggaggcggaggttgcggtgagtcgatatctcgccattgtactctagtctgggtgtcagagtgagaccctcttttttttttgagaaaaaaaataaaagaagaagcggaggctcctgctgttgaatagacaccctttgaggcaatgaatgacacatgttagcaaggagcccatcttatctacgactcatcctcaaaaggtccccaacctgaagcagccagtgcctgtggtggtgtagatggtgtctggaaaggctgagaggacctcacttctttcactcaccaaattgagtacctgtaatcccagcaccttggggtgccaagacaggaggatcccttaaggccaagagttcgagaccagcctgggcaacaaagtgagaccttgtctctataaaaaatcagaaaattagccgggtgtggtggcaggtgcctgtggtcccagctacacaggaggctgaggcaggagaatcacttgagcctagaggtcgaggttgcagtgagccatgattgcaccactgccctccagcctgggtaacatagcaagaccctgtctttaaaaaaaaaaaaaaaaaaaagattcgaagatctttgaacattatagagaacattacaatggaatgttatagtattagtattgttgatattttaaaacccaggagctgttagctcctcctctctggcctcttaatcataaatccctgtcccttctctattgggttacaagtcaactgaggcaccagcatgtaagcctcatctatacttactcaactaattcagacaggtctaggcctgtagggggtggcgtggggtgcagtctgggtgcaggggagagatggacccaccagggagagctaattatatcacaagtagaggaacctgtgggaagagtatagtgttggacatgtgggtgctgctttataacctcttcatttctcaaattcctcaaggagaacctacattaaggggtgaccaaccagctgaacaattccctttgctgtcaatctatgacgaggggtaaaacatgactagtgcactaaaatatcactggaaatagaacttcaaagatgaaaatttttttaaatcagaaatctcacagagagtactcaatagggttggagtaaataccttgatgagccacttggggatgggggtggaaggtaagaccccaaggggtatgcctggatgacaacagatggtccttctaaaaaggatagtcaagtgaactatgaggctgttgttttggagagaggttgtaagtttggggccagagttaaagccccttggattttggaggctttgcagctgatggtcctcctctttatcctttttctacagggcactgaggaactatttaaagaaaatacaacccaagtatctgcaggtctcattctggtccagccccaaagcagtgttagctgcaggggaaggccttaccctgaggagagggagataggatgtaccagctgatgtgggggagtgaggacacaggattagaggggagtggatactgtgaattgcacctagaaacaacagcgctaaggcaggcttcttccccttgaactatgcttccattaggggaagaatgcataaaatgagtaaaataaaagctgcagaccaggcatggtggctcatgcctataatccctgcactttgggaggccatattgtacggattgcttgagcccaggagttgaagaccagccctggcaatgtagcaagatcctgtgtctacaaataataatttaaaaaaattagcctggcatagtgacacatgcctatggtcccagttactcaagaggttaaggcaggaggattgcctaagcccaggaggttaaagctgcagtgagccatgatcatgccactatactccagcctaggggacagagtgagaccctgtctcaattaaaaaaaaaaaaaaggtatattccctgggccaggttttctctctctgtttatctggctaactcaaatttaacctttagggttgagattagatcttacttctcccaggaagccttttctgatctcctaagtctgcattagatgtcattcctctgtgctccgacagatcctgtatttcccccatcatcacagcatttacagtgtgcattgtcattgcttggttacaaggcaatttcctttgctagtctataacttccatggggtagggaccatgtctgtagttcactgtcgtttggtgccaaacatagtacctgatacctggtaggcactcaattatttgttgtttgaatgaaataatagaggcacaagaatagtgctgccatgtacctagaagaggtggaaaattttcatggtggagggtggctccctgaggccaggccttggtatagaggctgatggacagaacagtagctcgtggatttcgggggcagtgatggcttcagacagcctgatacgttaggaggagagaggataccaaaacagcaccttcgaagtcaggagctacgtggaaacagaatggaagacatcagctaaaagacaccctagggacttctgcctctcctcaccctctagcaatataagtgcggaaggagaaagtccccaaatacagtgatgcaccacttaaaaatgcattctgagaagtgcattgataggtgattttgtcattgtgtgaaccttatagtatgtgcttacacaaatgtagatggtggagcctactacacacctagcctgtatggcgttgcttattgctcccaggtggcaaacacgtatagcatgttactgtactgaatactgtaggcaattgtaatacaatggtcagtatttgtgtatccaaacatatctaaacatagaaaaggtacagtaaaaatatggtatatgtgatattttggtatacatattggctttcgtccgcagctcctgactcataactcccatagcccttgttatataatgttggggtgcttcaggcctcagaaaacagaatgtctgtctctctggccttccgaccacctcctgccctcctttttctccccaaggcaggactcttctctcacctctcttggagctgaccataaagaaattctcttacctaccctatctgactgtaggtcataagaacccccaattcagaaggagtcctgccccacacccaggaagaacaaatgctgcacagagatgccaagaagaatctgaacagacaggccttgctgggtttctccactcagtctattagtattagaccatacccttcttgcccatttctgcatgattgtcaatcatgactacccaatgaagtctccacaaaggcacaagaggactgggtacagagtatttccaggtagctgagcacatggaggtttctggagagtggcacacccaagcagggcatggaagctccgagccccttccccatacctcgccctgtgtgtctctgcatctgcatgctttgtggtattctttataatatatcattttttgtgtattataaagaatatataaatgtgtttccctgagtgctgtgaacagcactggcaaattaatcgagtcaaaagaggaggatgtaggaatctcaacttaaagccagttggtcagaagttccagaggtccagacttctgacaggtatgtgaagtaggggcagtcttggggactgtatgatctgacactatctccaggtagagagcatcagaatgaattgaactggaggacaccaagctagcgtgtctgtagaatcgactgcttgcttggtggtggcaagaaaccgccatacatttggtctcaggagtcttttgtggttgtgatgtgagaggagagtaacaacagtttttgttttttccactaagtataaaagataaaaacgtatactcctgtatagggcacttaccataaatagagtttgcaggactcaacgctgttctgggtgagtcagtgagtgagtggtgagtgaatgtgaagggctaggacattactatacactactgtggactttataaacactctatacttaggctacactaaatttaacacattttttttctttaataagaaattaatctcagcttactgtaaattttttactttataaactttataattttttaaactttttgactcttttgtaataacacttagcttaaacacaaacacattgtacagctgtacaaaaatattttctctgtttatatctttattctataagctttattctattatcttaaatttttaattttttctttttttttttgttaaaaactaggacacaaagacacacattagcttaggcctacacagggtcaggatcatcaatatcactgtcttccacctccacatcttgtcccactcggaggtctttagggacaataccatgcatagagctgtcatctcctatgattacaatgccttcttctggaatacttcctgaaggacctcccagaggctgtttaacagttacctttttttttttcaataagtaggagtacactctaaaacaacaaaatatatagtaaatacataaaccagtaacatggtcatttattatcattctcaagtattatgtactgtatataactgtatgtgctagactcttatatgactggcagcaagtggatctgtttatactgggcatcaccataaacacataagtaatgcattgtgctaggactttatgacagctacatggttattaggctacaggaatttttcagctccgtgataatcttctgggaccccgtcatatatgtggtccatttggctgaaatgtcactatgcagtgcttgactataatcctgcttgcagcattttgtaccccaaccataccctcaggatgatatgcctggagaaatgccagttacacctggccgtaacacccacagtcttggttcatgttctcatcatcacagttgcattagatgccttaatgatcaccctcctctatttgggccatggagccctttgagaatccaacaataactctgaacctctccacagaagaatcacatggtcacacaagcacaaaattttacatataacagacaacccttaaaagctaatctacagaccctagctctcatcttaatcttttctaaatttttctccatagtgctgccagggtgaacttgaaaaataaattttattgcattgttggatttttattaccttcagggaagacttcaagctccctagtaaagtacatgagacacctcccacatactgctcacgttccttacctaccttttttactccaccactgctgcagcaatgagctggtgtgacccatttctttggagaaatgtctgctcagatcctttgcccattctttttggttcccaagttttattcaagaattcattcaaaatattccagataaataaaatttaatcctcatctttctcttcttctttgtcctggttaatttggaaataacgtaattcataactctctttactgttagcaactatgcacaaccaatcacatagattattgttcttcaaatattttttggtgagatatttcaaataccttctggaaaaaggcacttccggtgttacggtgagcttgctcttgctcctttcgatggtcaccactcctccaagattcacagcttttctgttcactttgatcctctcttgcaaaaactgctcaaaattggtagaatggcggcatccatgattccatcttctatggggtggatgcaatcaagagtgaacttcagaacctgcttcttttttgccccctttcaccacaagctttttcgcgggcgccatggtggcaatggaggcagaaaagccctttgcccatttttaaaattgggttatttgttcttctgctattgagttgtaagagttccttatattttttggatattaattccttatcagatatgtggtttgcaattatattttcctagtccgtaggttgcttttcaagtttgttgattgtttcctctcctgtgcagaattttttagtttgatgtagtccctttatttatttttgtttttgtagcctgagcttctgatgtgatattaagaaaaagaaaaatcaggccgggcgcagtggctcacacctgtaatctcagcactttgggaggtcaaggcgggtggatcatttgaggtcaatagttcgagaccagcctggccaacatggtgaaaccccatctctactaaaaatacaaaaattagccaggcgtggtggcacgtgcctgtagtcccagctactcgggaggctgaggcaggagaattgcttgaacccgggaggcagaagttgcagtgaaccaagattgcgccactgcactccagcctgggtgacagaacgagagattccgtttcaaaaaacaatcattgtcaaggcaaatgtcgagaggtttttcccctgtgttctcttctaggagttttatggtttcaggtccacagtacactgttagtgggaatgtagattggtacagtcattataggaaacagtatggaggttcctaaagaaattaaaaatggaactaccatatgatgcagcaatccctctcctgagtatattcccaaaggagaggaaatcatcaccttgtaaacatgtctgcactcccctgttcattgttatgttattcacaatagccaagataaggaaacaaactaagtgcccattgacatttaggatggataaagaaaatgggttttgtggtgtacatacaaggtattttcaaaaagttcatggaaagtctgtattatataaaaaaaaaaaaaaaactatgtggccgggcgcggtggctcaggcctgtaatctcagcactttgggaggtcgaggcgggcggatcatgaggtcaggagatcgagactatcctggctaacacggtgaaacaatgtctctactaaaaaatacaaaaaaaaattagccgggcgtgatggcgagtgcctgtagtcccagctactccggaggctgaggcaggagaatggcgtgaacccgggaggcggagcttgcagtgagccgagttcgctccactgcactccagcctgggcgacagagcaagactccgtctcaaaaaaaaaaaaacaaaaacaaaaaaacaaacaaacaaagaaaacactgtgtatggatttcaaaattgttcacaacaaaataaactagtactaacttgtttataacatgtctggtcaggatctagttagagacactaaggacaacacatcagtttgaaaagagtcccctgtcggagcaacatgaattctgctaaaattgaagcaagaacaagcatcaaatgtatggtgaagcttgtgtgaaagaatgatcaaatcactgattctttacaaaaagtttatggaaacaatccccaaagaaatcagcagtttacaaatggataacttgttttaaaaacagatgaggcaatgttgaagatgaagcccatagtggcagaccatccacatcaattttcaagggaaaaattaatcttgttcatgccctaattgaagagaattgatgactaacagcaaaaacaatagccaacaccagagacatctcaactggttccacttacgtaaatctgactgaaaaattcaagttgaataaactttccacgcaatgggtgccaaaaccgttgcacccagatcagctgcaggcaagagcagagctttcaatccaaattttaaagaagtgacatcaagctcctaaagcaaaacaattgtaatgggagatgaaacatggctttacaggtacgatcttgaagacaaagcccaaagcaatggccaccaagaggtggaaatggtcgagtcaaagcaaaagtggattggtcaaaagaaaaggtcatgacaacagttttgtgggatgctcaaggcattttgcttgttggcattctgaagggccaaagaacagtaacatctgcatattatgagagtgttttgagaaagttagccaaagctttagcagaaaattccctgggaaagcttcaccatagagtccttctccaccatggcaatgtccctgctcatttctctcatcaaacaacgataatctttttagagtttcattgggaaatcattaggcatccaccttacagtcctgatttggcttcttctgacattttttggtttcctattcttaaaaaaaccctataaggtacacccatttttcttcagttagtaatgtaaaaacgactgcattgatgtggttaaattcccaagaccctcagttcttcagagatggactaaatggctggtatcattgctttcaaaagcatcttgaacttgatggagattatgttgagaaatagtttatattttcaatttttatcttttaattccatttttccgtgaaccttttgtagctccccccatacaatggaatattatgcagtcttaaaaaaagaaaaggagaccctgtcatttgccacaacatgggtggacttggaggacattaggctaagtggaataatccagatacagagagaaaaacattgcatgacctcacttatacatggcattttaaaaagggctcaaatacacagagagaatgaaacagtggttaccatgattgggtggtggggagaggaaatgagacactgtaagtcaaaggatacgaaatatgaaaagtctccacatctaaggtccaacatgaagactaaagttaaaaaaaactgtatcatattgggaatttgtgttaaataagtagattttagctgcccttgtcacaaaaaagtaactatttgagatgatagaaacattaatctgcttcataactgtaaccatattactatttatatgtatcccataacattgtgctgtaaacctcaagtatacacaatttaaaaaattttttggctgagcacagtggctcacgcctgtaatcccagaactttgggaggccgaggtgggtggatcacctgaggtcaggagttcgagaccaacctgatcaacatggcgaaaccccgtctctactaaaaatacaaaaattagccaggcatagtggcacacgcctgtaatcccagctattcagaggctgaggcaggggaatcgtttgaaccctggagttggaggttgcagtgagctgagattgcgccattgcaccccagcctgggcaacaagagtgaaactacatctcaaaaaaaacaaaatatttttttttttaatgacctctccccaattttcattacctgaccttcctctaggatctcatggtcctgggctcccctcttcatagcacttactgctgagctgtaaatatccatttatgtgttgcctccctcactggactgtaaaattcttgaggcagaaccagtaggttttatctatttatccttctcaagcctaggacagtgcctgagaccttgaaactcggtgattgttggttgacaggttgaatgagtgatctatgagatttctgaatcaagcctggtgcatttaatctttgggtcttgataacatctggatctgaatgaatctgggggaaagtctaattgagcttgatttccctgtgacctgcagaggcaggagtcccagcttgactggtagagtgggtggggaaggcctcttctacagcacagccataaaaaatctggaattgtgacactttcccctaatgggcctcctgggactttacatgtcctgttgtggggagttgattttaacacagaatctgtcaatgctctatccttttcaggtccagcttcataaaaatattcaaggaatcatgtcttctgattttgcttgatgatccctcttgggagccatatttgaaaggttacagtttgcatttttgacattaaagtttactttttaattttaaaaaaagttacaaagatgtaggacgtttggcttcttcaatacttatttgctagaagactttgggcaagttacctaaactctctgggcttcaatgtcctcccatacatgtaagctaaatgttccagggccacctatgcccatgggtaacaggccagcacaagaatatgctgaccaattgattcctggctgcataaccacagaatctcctctgttatttctaggtgcctagaggaggtctctcatagatgcccacgttctcttgacaagatatttggggaggacccctggctactgtcactgctgccatgcctgccaggaggaggcaccttcctgacacttcactgctgctgctcagcaggcctgccaagtggttctgctgtgttctaggagaaacaggaaaaatgcctctcctcccactttgcactgtgctttgtcacctgggccctaaaacaccattgcctgcccctgacgccccaacagctccctctaccaaactgaggctgggctgggagactaggcactacaccattccattctcccttctcttcttccattctcccttccctccctctcttcttcccactgcctccaagacacctgtactggaactttgtccattcttacactcacacacacacacatgcacatgcatatgtgtacacacaaaagtctcttgtccatcagatcatacaaatatatgcttgggacaggggtgatcacatgccccacatgcccagtggacatttaggctcagataggacaattctttcacaaggatgacaaaacctaccttccgtggttgctgtgagaacaagaaattgtacatacagtgcccattctacagcaaacccaacaatgatttaaaatccacaataggccgtgcggtggctcacgcctgtaatcccagtactttggggggctgaggcgggcggatcacgagatcaggagatcgagaccatcctggctaacacggtgaaaccccgtctctattaaaaatataaaaaattagccaggcatggtggcaggcgcctgtagtcccagctacttgggaggctgaggcaggagaatggcgtgaacccaggaggcgaagcttgcagtgagccgagatcgtgccactgcactccagcctgggcgacagagcaagactccatctcaaaaaaaaaaaaaaaaaaaaattccagaatatatagagagcaccttaagagtcaataagaaaaaaagacaaaccaatatacaaaaagtgagcaaaagatatcaacaattaattgaaaatacaaataaccaataaaaatatgaaaatatattcttaatcttattaagtatgcaggtaaagacaaattaaaacaatgaaataccaatttttattcatcagattggccaaaactaaagcctgaaaatataaagtgtccatcttgctgtgtgtaaatgggaaatctgaatctgatggtggaggcgtaaattggacagctttttgaaaagaatgatttagcagtatctattacaatgaaaaacatagatacctttgcctcagtaagtttacctccaggtgtgtatcctaaagaaatacttagaaatgtacctccaagagacatgtacaaggaagttcccttatgcattgtttgtaaaagtaaaacagtgatgatctcaatgcccactgataggggaaaggtttaattcaccatgattcataaataaagagaaattctatataaagtggaatagatttgtgtggcatggaaggatcgccaaaaagtattttaagattaaaaaaaaagtaaaaaatatgtgcagaattatgcctttttttcatagaaaaaagtctaggggattcaccgctcagcaggccatcctggctatctgggcataaccaccacccagagtgtaatttcttctaaggcaatcacccaagtctttcacattttataccttcacagccctgacaaaaactgctacataataaacactaaacaaatgcctatgaaaggcaagaaggacgtaagagagggaaagaagcaaagaaatgaacaatcgtagcacctgaggccggattaaagaaaggaaaaaagcttgtaagggtcttttcatattgacaaagctttagtggaacactcttttggtgggttttcaagggatcagaacgtttgggcagaaaacagaaaaatacagacataaagaagagacctaaatatataagcataacattgggaaaaagccttttcagaactgcaactcatgccttattcgaacatgttctgaacaaggtctcttatctaaagttgtttctggcttcagacagcaggtggcagcagaatcaagctttctggttgcagaaacttctggagccagccagctgtataaagtttcaaatggttttcggaggagaagcagcttttgagtaaaaacctttaatctaaaaatctaaactcgacacaaaacaaaaacaaaacagagtgaggagctggtgccattggcccctgccatgacagatcctgatgtcattccctgcctgccatctacagagccacaccttgtccttcgaagaaattctgggatttctactggcagcggccaggaaaggaacccaaggttggtctgtcctgttctgacgttgtccttgtcacatgtggaagctggttcgccaggaaacaggctctggtcaaggctgggctcactggagaggtcagcccaaactcaaaacacatttatgggtaaaggaagggttttttaaaaggagactttgcaggcaacaaaaagaaatatagtattgatatatgccacaatgtggatgaacctcaaaaacattatgttaagtcaaagaaatcagtcacaaaaagaccacataatgcatgaaaccatttataggaaatcttcagaataggcaaatctaaagacagaaaatagattagtggttgtctagggctcaggaggtggtgactggggaatgactgctaatgagtacacaatttctttggggagtgatgaaaatattctataattagattacagtgatgatgcacaattctttaaatatacttaaaaaccattgagttgtacgctttaaatgcgtgaactttatggtatgtaagttatctcaataaagctattaaaaaagggaaaaaaaaaagggcccagcactttgggaggctgaggctggaggattgcttgaaaccaggatttcaagaccagcctggacaacatagtgagaccccccatctctacaaaaaataaaaactagctgggcgtggtggctcatgcttgtattcctggctactctggaggctgaggctagaggactgcttgagcccaggagttcgaagacacagtgaactatgattgtgccactgcacttcagtctgggataaccattcaatgctgggggggtggggagagagagagagagagagtctatgcagttgctacagaaaagaattggagattggttagagatatgactggtacattgatgaattttactttttgatcagattgtgatatgatggtagcataattcgcttcctgatttggtcacacacacttcctatccctaagaactgcaaatacttacctgaaagagtggatgaggtgcgttgccatctcacttttttaggggatggtgctctccctggaaagaaggcaataacaggccagtgaaatagcagacatctgaagtcacacagacgtggtttcaaattccggttcttcctcttattagctatgagccgtcagcttcttttccatacccacatctcaaggttaagtaagaattacaacataaaatataaaagtgcccaacccagagtaaacttgaaatttatttaatattcttggaatttccatcctgaccagtaagatgacattttatctcaaaacacagctgtatcatgttttgctattggtacacctctaaagatcttctccaccgccctctgcccccaccccaactccaagtgccatgaataacctaacttattatcactttttacaacgatgagcagcctctgagaatggaaaaataagtcaatggtaatactgtgttaggaaggatctgagtaggagggaacctgtcccctggctaccagaaacacaggactagacccagtaatacacacctagaatataagcctggataacaacagtgcaggagaaacactgtcctcaccaggatagcttttatatgcaagaatttaggtattataatcagaaagatttctagaaactatgaaatattagggaaaaaagccaacacattagccaacattgtactttacatttatgcaaattttaaactctataggcacctcctagtagctttgggggaaaataatactctgtgcatcgtgtaatggataagaaaatgagttaaagggccgggtgcggtggctcatgcctgtaatcccagcactttggaaggccgaggcgggtggatcacctgaggtcaggcgttcgagaccagcctgaccaacatggtgaaaacctgcctccactaaaaacacaaaattagctgggggtggtggtgcatgcctgtaatcccagctacttaggaggctgaggcaggagaattgcttgaacctgagaggcggaggttgcaatgagctgagatcgcacccttgcactccagcctgggcaacaacagcaaaaactccacctcaaaaaaaaaaaaaaaaagaaaagaaaagaaaatgagctaaggagctaggcttccttatttcacaaccttggctctgtctcctatgaaaccagggcaactatttaacccctccatgtctgagtttcctcatgtataaatgaagggagcaatagtacctagcttataaggccattataaggattttaaaagttaatctaaagtgcttaggacagtgtatggcatagagcaagcactcagtaaatccattcattcaataaatgtttattgaatataggtgtggctgctgttttggctgatgagtatactaaagtcagtgaaacagacgaaatctgtggagctttcttccttgggggaggaggccaacaacaacaacgaatacacacagaggaagagcaatggaatgaattgtgttccctcccctcccaaattcatatgttgaagccctaactgccaacgtgatggtatctggagatggggcatttgggaaataattagatttagaagagatcatgaaggtgggagactcgtgatgggattagtgcccttttaagaagagaaagagtcaggtgcagtggctcttgcctgtaatctcagcactttgggaggccaaagcaggaggatcgcttgagtccagagtttgagaccagcctgggcaacatggtgagacgccatctctataaaaataaaaataaaaaattagcccagtgtggtggcacacacccatagtctcagctacttgggaggctgaggcgggaggttgaggctgcagtgagctatggttctcatcagtgcactccagcatgggtgacagagcaagactgtctcaaaatgaaagaaaaaacaagagagagagagagatacaccagggctctctctatgtcctgtgaggacacagcaagaaggcagctgactgcaagccaggaagagagcccttaccaggaactgaagctgtcagcacctttatcttggacttcccaacctacagaactgtgagaactaaatgtgtgttgtttaacagacattttgtctatggtattttgtttgttgttggtatttgttgacattttggtattggtgtgttgtttgttggtattttgctatcagcaacccggcagactaatatagatttatatgtaaacatatatttgaataggaaccctgcagaagccacatagctggttttactgatgcaaagagccctatgctatagtatgatgaggtgaagggcttacatttccctttcagcagtggtatccactctccacagcgtagacttggagaagccacttgactctcatcttagattcctgcatctgtaaaatgatgaactagatgatacccaaaattttagattctatccatcttatggttggaataacagcccaccttctaggtcaattacacacacaggtgtgctgatgcttagggtggcagagagggtgtcccacaagtagacactgattatcctaactgtaactttcaaatggaaaattaattaaatctctaaatttggatttggcttcctagttagcactgtttccttcctggaaaagaaatagttatgtgtcagacagaacagccccctctgatcatttttttccttcttccttgcattattgttagctctgactgtgcagctctcctggtgtctctccctttctagataacagcctagaaaaaggagcttatggtttccctgaggttcttttgataaatggctgacatttgattgaaccattctcatttcacttatttttcactttcacagaaaaactgtagtaggtataacagcacaaggtaatcatttttaaattattcagacatttttaaaaatttgattctgcttctctcacctctgaaagatgttactggggtgtcttggttgcaaagattcattcaagttcttttgcttttggattctccatattctctgaggaagtgactgcatctaagactgtgtccaaggaagcatcttatcactttcatcctttgatccctgagtgcctttcactaccagatatactaaaacaaaaatcttctcttagctccctggtgcagtggagttgagggataaccacaaagaattcagagtacatcacataacggaactgtcaggaagcttttgatggcagaaacatattttcctggtgatgagattagaaggatcttcatataaccatcagatatgttattgtcacttctgaacaatgctttttatagcagattgtttctcaaaaaggaaatagaaatgcgattttaaaatatgaaaaatatgttcaatctcattattaagataaatgcaaatacaaattataagaggacttaacagattggcaaacatcagaaaagtgaacaacctcctccactggcattcttttttttttttttttgagatggagtttcactcttgttgcccaggctagagtgcagtggtacgatctcagctcactgtaacctccaccttccagtttcaagcgattcttctgactcagcctcctgagtagctgggattacaggctcctgccaccacacccgactaatttttgtattttcagtagagatggggtttcaccatgttggccaggcttgtcttaaactcctgacctcatgatccgcccgccttggcctcgggagtataatttgctgtatggagggcaatttgacagtatctatcagattttataatgtacagagccttgaattcagtaattctacttttaggaacttatcccacagatattccagacatgctcaaagatgtaggtacaaagattttattgcagtattatttgtaagagtaaaaaaccagtccatgaggaagactagttcaataagttaataatctagaatatatcgatataatggaatactatcaaagaacaattttcacaatgtatttttaagagggggaaggtacagaaacatatgtaaggagtttcatttgtttaatatacaattagtgacacaggttgcatctggggaggaaaattagggaacaattttttgttgtacacctttatctttcattgtatctctttcaaaaccttttgtaccatttgtgtgtattgtgtattttaaaaattaatttaaatttcaacaaccgttatagtgatgcaaaaaaccctatagaaataacagtttacattcaattttgctatatgtcaggtactgatttttcaaccacaaccttgtaagatacgtgctattatcatccccacttcacagggggaaacctgtggtagagagaagctgaataacttgtacaaggattcatacctaatcagtagcagagctcagatttgaacccaggcagcctgtttccagagaccatactttacccaccattctatactgctctgaggtcacagacctccatgatgaactcttaattgagtgcagtcaataggaaactcagataaactcagatgtacaagaaatatctcacttcttcatttgcttttcacctacttaactctgactctgagtccccatccagcttgattggcagaaattgtaatctcagtcattatttggactctccactgcaagggtttttcaaggtcctggaatcttacatggcaccaaagcttggcagagatcctgccagttgtcaatacatactggttaccactgacatgtccattgcagtccagtactctcctgcggccatgtgtagtcctactcaccctcacccatagactgaaaacttccttatattcttgggaaattttctcctttccttttcctgctgccttcaaagacattgataatactatcttcattgagttcaggttttatctacagacagctagatcattctgcaaaatatctctaaggtaagaaattactaagggcctacctaactcacttagatcaaaggggtagagaaagtacagaaagtagacaaagaaattaatatttcaatagattatcctgccacagagtcatagccatgaaaaacaataactttggatttggaatttacctcctacctcaagtttccctctgcaagtgtttggacttgcatgttatggaatgatgattgtaatgaaccatgccttctattggtagcagattttgactgagatataggacagttaacaactgcagtttgaatgcaaaggcagacagagtacactttgcacaagggacaaagaactgatagggaaacaaggacagtctccttttacaccttaaaaatcctcaaataagaacctggcttctgctcagctaaccgacacataagtgcagaaaaaaagacaagattggaatccaaggaaggaaatgttagaatccaagggccaggaatcaaagagaatatatttaaatagaaaccaggttgatactagaactttgggatgcctagagtaggcgggaaaaagatgtatgatctaagcacaggatatttcgaatacaggagcttggataagaagtctatcccaaattccatctgccaccaatgaaagcagaaaggaaatacgtaatgagagccaagccatggggaaatagtccaagatgggtgtgcctcctgtgtatttagtaatcatgtccagctcagcaaatctgagtttctttattccttgagccactgtccattttaatgaacagggaacatttgatctcaagcagcttcagaaactcaattttcccccagcctttgtctaggttttatagaggaaaaggtatagttgcagtactggttgatatttgcttgtgagagctcttgggcaggtaattcttgatcctttgctccacctagtggatttccaggctagagagactctggaaaagagatcagtgatcagaagggtgtacatttgctgataaatgagacttaccagtcagtttctggattatcgtcagtttctggattatcgtctgtttctttactgacgatacccgattccatcccaaagtgtccttgtttgaattgattgaaatctttcatttatttccattaatgccagatgtgtagctgtaagtcatcaaaatctaatgcattccttttctctcttcttaatatataaataacattatataatcaggagacccatatcagcacaagaaagcatattctacttataattatatcctctgagggccaaacacactcaaacctcaacagagtcatttaattaaacaatgacctacctgcttaacactttggggactcctttgaacaataattggttaaagagtcataggaccctttctcaagaagtttcacatccaattataaaaacagatgaaataacactggaaagcagggcgacgctgaaaaatttcaggtagaagagaattcagagctgactcttacacaatatccatatgtggagataaaattagtgttaatgtaggtttaagccattagagttacaacataaatttgacaatctatgcttacttgctggctgaccatgtccctgtcagttaccagccttaaaggctaccaaggcattattctttattccttacctatatttaatacttactttttgttatgggttgaattgtgtcccccaagtattcatatgttgaagtgctaaccctcagtccctcagaatgtgaccttatttggagatagggtctttatagaggtaatcaagttaaaatgaggtcattagggcatctctactccaatatgcctgctatccttataaagaggggaaatttggagacagatgcacacaaaggaagaacaccatatgaagatgaagatggccctctacaggccaaggagaggagcctggaatggattccttcctcacttccctcagaaacaaccaactctgctaatacctcgatattgggttcccagcctccagaactgtgagaagataaatttctgttgcttaagtcacccagtttgaagaactttgaatggcagccctagtgaattagttcaattgcctctggcaaatgaataagaagctcactgcaaaaatgaaattaatccaccgagtgctagagttggacgggatctcagaaaatgtattgcacaatccccttgttttgaaataaatgcccaaggtcacacagcaagttggtgacttagtcactcttttagctcaactttcagtccatcaacgttctatcacagtctgccaactatttcaaagatggtggcaaaatcagccaatgatggtgattagatccaaaacttagttgcaaataatttttcggggaactatatgcaagcataggtccttcctaaatatttgctaatggaagcatgtgctaaataggatgcctaccagaagactgatacccagcagaatagctagacaggtaatttgacctctggctgggcccgtaggattcatcatccctccagacaagcacttggttgtggtaaagatctggctctggttggaaggctgtcccatcccactgagggtgattcaccagagcaacttaatcatctacggatcagaagctcaggttcatgtgagcagggtgggggttaagggaaagagagtctgagtaatgcttcacagtgggtgtggggacttgttataatagtaggcacgctgttgattaaagtacatgacagaagtaattgccagagatcccaaaccagccatcacctagcattagagatgtatctaatatcagacagaaagcctagtttcaactctgcagcagaggcctttgaaaagtctccagaagtaattggcacttaatcaatgcaatcattattacagcacatggctactgcagcttcaggccctcttgcaaccactgaactgcaaaagaggagactatgtctgtagaattttaccaccaacacaacatttgattcacaatctcagactagacaggagtgaacatattttcatatttatatattttagaaatacaggttcactgtcaataagaattcagtcttgtataaatgatggtataaacagggaggggcattttccctttacagaggcttaatcagcattaattttgagagataggaaagcaaaatctaccacaggctgttaagcatttgtttttcatctaatcttctcaaccctccattcaatatttgggggagtatgactgtttatcacttgctgagatatgcaaggtgcacatgctgcttataattaaggaacaaagaaatgttgactttgctcttggtcttgcttcataaagtgttaccactgggcatcaaattgggtgtttaaaggagaatatacctctcttggagagtagacacgatttttaggcctagatcgtctcttcttttccccgcaggagttcgtagttaactttccatcactctgtaaaaggcaattagaaaaaagaaaaagcccaagttcccctcttggcatcttgcagaagtctttcatgcataatggatgagaggaaatggggagaaagaaaagaaacatcctgaaatttaagcacccgtaaatgttttcatagatgttggtagtctatttcagtgtttttcaaaggatattcccagattacccacttcaggataagctgcattgttgacaatgcagattgccaggcctcaatattagacctgaatcagaatttatgggactaggaccctggaatctacattgttagcaagtgtctccagggattcctgtatacactgaaatggagcctactcatctatcttccatagtctaaacagtgctgtgctcagtatctccctccctacacctctcccttgttaatcaaatcaagtctctcatatttaaatgtctttttgtatgcagatggctctcaaatttatatccacagcccacacctcttccctaaaactccagaatcctataccctactgcctgattgacatttaataggcatattcaaaaacaaactcttgaattttctctccaaacttgtccttcttcatctccataaatagcaccatgattaccataaaaccttgaagtcactgttgactgcatccttggcatcttcctcactttctctcatattcatttccaatccatcagagtactgtcagctctactttcaaaatatgccccaaatcttcctctatctcgaagaccagataggaggctgctatcaaaatatgatgttttgattatataatatatattatattatagacttgatatattgtatactcacagctacacatttggcattagtggaaataaatgaaagatttcaatcaattcaaacaaggacacgtcgggatggaatagggtatcgtcagtaaagaaactgacaataatccagaaacgggctggtaagtctcatttatcagctaatgtacacacttctgatagcagcctcttatctggtcccactgcatgttttctgtatcagccagagttcatttgcagataacagaagccattctagctatttgaagcagaaagggattcaaaacagttgtggtagattgatgttacaaaaatccttcctgtttcacccacctttttgcaattgccacaactcccataaagagatgaagtctatttttctctccttgtaaatctgggctagccctcggtttaattctgaccaatggaaagaggcagaactgatgctgtgtcacttccagacctagccttaagaggctttgcggctcccactctcaccctcttagaagaaagcagccgtcctgtaaggaagctcaggctagattactgaatgatgagagaccataggagagagaggtctcagcctttcaaggcatccctgccaaaatcctagacatacgagtgagacaaagtagggccactgacagctgaatacacccacctgcctgtggagccaggcaggatcagcagaattgcccagccaaactaagtttttggggtgcttattacacagcaagagataactgaaatgtcactaaatttagggattgcaaaaccattggagggttggtggggcaggctgtaaatgtggcctccaggaatgactcacagaataacaccacagaactgccctgttagaagaatcgccgctcctaccatagtctgaaagctaaggatcaagaagccatcaaccactttctagcttcagaaacacactatcttagtcatgctctggacatcaggaagtctccacaagtctgttggcttcagaatcataccacagatcaattttagatagcaaaatggataaagtgctgtgaccaccttttccccactgaagtttgttctgaaatcaagacttatgcaaatgcatataactagcaaaaagtaaattatataaacccctagctgcaagagaatctttttagcttttttattttttatgtttattttttgtggcagggtcttgctctgttgcctaggctggaatgcattggtgcaaacatggctcactgcagccttgagcttctgggctcagaccttcctcccacctcagcctcccatgtagttgggaccacatgtgcatgtcaccatgccccgctaatttcttgattttttctagagactggggtctcactttgttgccctgaatggtctcgaactcctgggctcaagcaatcctcctgtcttggactcccaaagtgtgggattaacaggcatgagctaccgcacccagcccacttttagctttttggcctaggcactgtgggtaggcatagaagaaagaatttttttaaaaatgctttgttcactgcgtaacgctcacaatagtgttcacacaaaagagatgctcattaaatatttgttaaatgattgaactaaagtttgataaagcaaaggcataacttagaaatgactgtctctagttcgcccaaagtatgaaattctgtatgcctaaaactctctttcagtaattctcttttatgaatatattctggaatatcaagaaagatctaggattcaggatttttttcagcccaatatttaccatctttactataagtgtacaaccatcccaagtcagacaagctgagtctatttggtttttttttgtaataaattttaattggaaaagatgaatttgggagaatgggaagaaggttttgaagggcaagcccttcagtcatttctgcttcctatggctttggccaccatctcactttgagggcttgttcttcaggatactgacagcttgatttctctgggtaatgtcacacaaaggaaattagctcagtatgtcttctactgaattccatctgtagctcaatgtttgaaggtatttgtgaacatgactacagagcaattttgataagacaaggcaatgttccagtctctgagaatattttccccaaagaactattttttaaaataccactgaacagcctgaaaacccacccacacatgagcaatctcctgcaatatacagaaagcttttcaggtgtcacagccataatagcaggtggttcctttgggtagaaaaattatggcaagaatatagcgacagaaagcaaactgttttgatattctgggtacaactttccccaagtgaatcattcccatatgcctacttttaccacgggcgcctttccagaggaagtgatttgtgtgaacggaggtgtagagatgcattctggtgggtacacttcattggtgcccatatttagcagatccaattaatcgtcagctatttgtcaacccattcctctgtaagtctcaaaatgcaaaattcgaatatgaatttgatacctatttttgctttccacataacaaatacataatcttgttatgaagattcagtagtgctcttttaaggcaaggctgcttctgaaattccatatgaatagatttttaaatacaagcttataaagaaggctgagattagagcaatttgcaaaaggcagtcatttaattcactttttattatgaaatatttgagacatacaaatagcttaaagagcttatttactctgctgtaaacttttgttgcttgtaagataaaaatctggacttgtaaaaaagactttgtttctagatagaacagcaaagttgcaaagtaagagttttgcataatttttttctttctctatagtgtataagactagcatttttattgtttacagataaaccaaatctcccttactgaaaagggagatgttgttgtccccatctcaatttaaaacaaaaatcaactaagctctaataggaaaagatgtgtacaggaagattgctaatggaaaacttttatttttacattttatttgtatttaatttttaaatttttatttgttttatttatttgaatggaagacaactgcattgaaaaataaaaagaaccgggtacggtggctcatgcctgtaatcccagcactttgggaggccgaggtgggtggatcacttgaggtcaggagttcaagaccagctgggccaacatggtgaaacaccgtctctagtaaaaatacaaaaaaattagccgggcattgtggcatgtgcctgtaatcccagctactcaggaggctgaggcaggagaattgcttgaactcaggaggtggaggttgcagtgagctgagatcacgccactgcactccagcctgagcaacagaggaagactccatctcaaaaaaaaaaaaaaaaaaaaaaagaaaaggaaaaaaagaaaaagaaagcacagttattaagctacttaattctgggctttccaaatcttagagtggtgtcatttgctagctgggtgaccacgaacaagttctttaacctctctgtgcctcagtttcctgatctctatggggaggataggatccatcagttaggggttacatgtgaagcacttggaacaatgcctggcacacagtaagccctctatcaatggtaactcattttcttctttaccctcaactagaaagtcagctccacatgacagcagcaattctgtcttgcttagttctgcagcctcagcatctattttgcccatagtaggcactgaataaatattcgttgaactaactggttaatgaaaaataactgggctttgaggttgaaagtcaaaggaaatttctcctaagttttatagctagtgagggaaaaatggacagcagtttagagtcagggaggtagaagaaaaccctaaactaagatgagaagcctgattgaagttcagattcttccaactctctgggtattgcaatcaggattttatttcttaatttgctcatttatttatttacttattattattattttttgagacagggtctcattttgttacccaggctggaatgtagtggcacaatcacagctcactgcatccttgatgtcccagctcaagtgatccttccacctccgcctcctgagtagctggactacaggcacgcgccaccacacctggctaatttttaaaatttttgtagacactaggcctcactttgttgcccaggctggtctcaaactcctggcctcgggtgatcctctggcctcagcctctcaaagggttgggattacggacgtgagccaccatgcctggactctttcttaatttgtaaaatgggaatgatagctcccaaggttattctgaggagtaaatgacactgcatgtgaaagctcttaataaactgtaaaggaatatacaaaagcatgatatagttaatttctatctcagtaagtttttccattggatgacaataaagggattctttgagagtgttggaaaaaggaatctttagctaaagatttcggtactaaaaatattcaaccccagaggtaccacagacatagactaattttttccatctgtgcagtttagggtagatttggcatacgctcaataccaggcaagaaagaaactatggtttaggctgcttttaaagttaaaaaaaaaaaaggcagaaaaggaaactatttccttttataagcaggaatgttaaaatagggaaagctttcatcgagcaattcactactgaatcaaaactatttgatccatattctcacctacctcccctcactccgtatttgtgttgtggttagttgtcttctagatcatggtttatatatcatggtcacttcctcactaaagttaaacaatatagattattcttaaccagccacatgtgactcagaggtcaaaagagtgttctttttgggtaatctctctcaattgctaatacttaaggacctggttttcagaaccattgattatttaaaatgtatgtctttaagattaggctccacccaagatgcctcctcagaggctaagtttgaggttgagaaactagcttaaggagaaagataaagtagcagaaatgtcatggcgggtgagctgatgactcactgccccttccttgaactgcaagaatgacaaaatggaaaaggggaaaaaaaaaggcaatgccctactgcagactagaggctccatgaaacccaagaaattccgagaacttgaagaactacatgggttcttagggtaaaggcagtaagtttaatttccatggtcaaattgttaagtgcatcaaagaaaggacattaggaaagctaaacttgattatactttaccatcagagccatcatcctcaatctgatcattttattctcctgcttaaaaacttcaataactccacattgctactggaccaagtctaaacttacaatcgtatagtagaatattcttcataacatataaccttccttgttaacttcaccttgtaattaattctttttttaaaaaaaatttatttattttttaacttttgagacagggtctcactctgtcacgcaggctggagcggagtggtccaatcatggctcactgcagcctcagcctcctaggctcaagtgatcctcctgccccagcctcccaagtacctgggactacaagcctgtgccatcaccctgggcttatttttgtattttttggtagagatgggttcccactatcttgcccaggctggtctcaaactcctggcctcaagcaatccttcctcctcagcctcccaaagtgctggtattataggtgtgggtcaccatgcctggccgaattaatttttattacatgtcttggaaggtatgggggacaacttagaacttcccaaataagcaagatacttttaaattcccatcaatttgtttacactattccctctgcttaaaactctcatcccagctggcaactcctaactgcttcaaagcctgcctcaagtatcatttcttctcagtagctttctcaattcctatgctctcttgctcaactcccactctctcctgctactcagaatgattgctctttcatctctggagtcatagcactttaagcatgcctttgttaaatcacttaacccaatgaaataaatggactcacagagttctatcctttcctcaacttactgtgtactccctgaaggcaagtgtgagcatgtcattgtacaattcttgccacactattggagaataatacaggtgtgttgaattgaatgaaatattaaaagaggaccaaagaatagatggatcttctaggcctaggaattatactaggagtagaaggtgtatcctaaatccatgtatgtgattctgctttggtcttaccagagtgaatgtaatttgcttttatttaaaaacagtgttgacaggccatgcacagtggctcatgcctgtaatcccagcactttgggaggccaacgcgggagaccacctgaggttaggagttcgagaccagcctaaccaacatggagaaactccatctctactaaaaatacaaaatgagctgggtgtggtggtacgtgcctgtaatcccagctacttgggaggctgaggctggagaattgcttgaacctgggaggcggaggttgtggtgagccaagatcacaccattgcagtccagcctgggcaacaagagtgaaactgcatctaaaaaaaaaaaatcccaaaaacagtgttggattcacactcatgcgtgtaatcccaatactttgggaggccgaggctggtggatcacttgaggccaagagttcaagaccaggctggccaacatggcaaaactccttctactaaaactacaaaaattagccaggcatggtggtgcatgcctgtagtcccagctactcgggggtgctgaggcatgagaatcgcttgaaccctggaggtggaagttgcagtgagctgagatcatgtcactgcactccagcctgggtaacagagcgagaccctctctcaaaaacaaacaaacaaacaaacaaacaaacaaaaaaagccccacaaaccagtgtcatttagccaggtgtggtgcatgcctgtggtcctagctacaggggaggctgaggcaggaggattgcttgagtccaggacttcaaagctgcagtgagctatgatcacaccactgcactccagcctgggcaacaaagcgagaccctgtctctaaagaaaacaacaacaacaacaaaaaaccctcaaaccacactagtgtcatgaatatatttctttagataaaactttattaatcagctttctgtttagaattggctttcccataatccagttaaccaaaggtagttgagtaatttgaaatattccccagctggagtagaatcacatttggggcttgcttcaatcagtgcacctctgtcttgcttttgcttttcagagagaccctaggtcaaccatagcctttgaaggcatgagctgaacggaaaccagatgaactctattgaattttaaatttgccacatttcctagtctagtattaaacttttcttctctagttgagcaagttaaccaaagaagtatatatatattttttctcttatagattatgctcacctaagaacttgaggttacaacacacacacacacacacacacacacccaaaaaaccaaatcgcaaaacaaattattccatactcattccattggttcttttgatggccttctgtcagtgttaatggttggtgtgaaagatttttggaaacgttttccaggagggagtaatagcatttcctgaagcaccttttatcttggtttgtggcaaatgattctttcaatgccctcaggtcacttataccctaagaccctgcatgagtttattcaaccttcaaatcagtcacttctgccctcatctagggcacataacaatgtagttagttacccagcaggtatcgcggctaagtaagaccataaataaatcatatgagcaggagcttttggagtcagtcttctgtctgagcacctctaaccggttatgctaccttaaacaaattacttaacttctctctgtctcacctgatttaccagtttaaaaaaaaaggaataataatggtacctacctcataggtttgttgtgaggagttaaacgtctaaagcacttagaacagtgtctggcatatggtaagtattcaataaacattagccttatattctatactttaagtaccatttatttatatttttacatacaatatgtgggcataacaaaaaattaaaggaagaatggtcatttttagaaaaaactttatttacaaaaccacaactcagtctgctttggtattgacaaaatccctacaactgagatattaaagagatacatttattttagagttacataaaaccagaatccaacactaccctactttcctattcctttgtggctctgaatgcagctttaaaaaaaacaaaacaaagcaaagcaaagcaaaacaaaacagctctttataatgtacaatggcttaagcaaatcgctttagtttttttttctatttaagatttaggacagactactcgtctaaaattcactatttacagagaaggtcctagggaacaggataacttatttaggtttagctctcataatacaatatccataatggctttagaagaatgtaaataaataacattggtaaacagcgtatactgatattttctgacaaactcatttatctaacatcatgctgagcaatcaagaggattcctctatatattttaaattttaatttattctatttcctgattcacaaactcttgctccatgttaaagcagttatcaccaatagaacctatgagaaccagtgcccatggaaacctaacagcttgtttttttaatcccctattaaaactcggttgaacttgatatatgcatggttgaaatatgcgtgggtactaggcctttattcaggaatgtaaaattaatggtatctggtatcaagttgtaagaaaaactcccccagattgggaggtaactgagtgatatgtgaaagaatcttcccgtctgaatttaagaatacacctacactgggcagaaaaaggtgggggagaggaagtagaagtagaggaaaagcacaactccactggcttcaatcaaactgaggtaactaattagagacagaaaataaataaatcaacaaatgccccatttttgttttccaaaaaagatcactggcaactaacaattttaaagttgatccattaatatatttttaaatagaaaaaagtttgtatatcatatatatcataattccatttatctaatacactcctctgctgagatatttaacacatcttcatctgtactctcttctatctctggcaagttgccccgaagtaggacgtttacacctgaaaataaaaagtcataaaattctttaatgcttactactgttataactcagaacacaaattacgaaactttatatgttaatattcttatgtaaaccatagtgttagcagtaaaaagagtagctattgaagaatgtactgcaaataaaattacctaatattatccatctaggacataaactttatttatttattttgagagaaattctctctgtgttgcccaggctggagtgcctggcaggatcacggttcacaatcacagatcactgcagcctgaacctccagggctcaagtgatcctcctacctcagcctcccaagtcacttggactacaggcgtgtactaccacacatggctaattttattttgtagatacaggttcccactatgttgcccaggctagtctcaaactcctgggctcaagcaatcctctctccttgacctcccaaactgttgggattacaggcatgagccaccatgcctggcaaacacttttttttaaagggctaggacataaacattctttaaatccttttaagcaagggcttgaattctagaattttacagctcaaaaggctctcaggagtccatttactcaaactctgcctccagctgcattataacataatcactatacactgataattttctgatctattttaatgatgtttaagaatggagatctcacaagatccttttagattaaatgcctctttggagggttcagggagaagtcctgaataagtctcctcatcccttcaataagcagagaagtagctggtgccatttttctgattcagaaaaaaagcaagggttcggagccagttataatatgaactgcaatccttggtaccagtgggtttcagtccacaggcagagctttaaactgaactttagggccaggttgcagcagtcactataataaacaaaagaataatcaaaaacttcactgagaaagaatagtcagatttcatattgaagaatgaagcacaggtatacagtaaatgactaaacatacagtagaggataatgacaagtttattactctgggcatatattacattattagttaaaagcactaaatggaaaataactgacctctaggatagccaattaacttcacaagaaaagcaaatctttttttttttctttttgagtcggagtctcgctctattgcccaggctggagtcgagtggtgtaatcttggctcactgcaacctctgcctcccaggttcaagtgattctcgtgcctcagcctcccgagtagctgggactacaggcgaatgccaccatgcctgggtaatttttgtatttttagtagagatggggtttcaccacgttggtcagggtggtcttgaactcctgacctcaggtgatccccctcgcctcggcctcccaaagtgctgggattacagatgtgagccaccacacttggccagaaaaacaaatcttaagctgtccagttatcagtgtggacacaaagaggatccagcaattcaggatacccaccccatatacactgagatagcagccacatggcggaatggaatgagccaggatttggagatttggtttgaatccagtgttcaccactgctagtacaccatgcatggttttactacaaatgcatgcaacatagacaatatatattactgtttagtggatttaaattttgtatagaatgttattacactacatattgttttctaatttgctttttcactcgtcatgtttttgaggttaatccatgttaacttgtgtagatttcgttcatttatttttacttctggagagtattccattttgtgaatttttaaaaatgttgcaaatacagcccattgctcatcccttcctcagctgcccatcttgcataggtggttcaaggcgacatgcacagggatgtgtagtgtgacattgttgaaacagtagaaataattaactgtttaccttgactgagggagatactggaatctaatctggcaagaatttagcatgtatctgatgctggtagggatacagatgtgtatcttattattttctataatcttttcgtgtttgaattgtttataatagaaaacgctaccccatccccacccccaccctaagaatgaatggtgttctgctccaggtaaatgtcatggaagagctgacaggaagagctgtaaggaattgcgaggcaaaaatcaaagtgaaaattagaacccataaatgtaaatggagggctgaagccattttgactctgagggcatttgccaatttcaggaaatttgagctgaggtttcccaaggctcctccagaaagttctgggaaatcaggtctctaaatgaagactagcctagaaaacagacctccaggagtccttttcagtttaaacattatagaatttataaggcttgtctatgcattcctttgacactgctggttcaggtgattcaaggacagttgtggcgccattagaaacttgctttgataccaagcatctagaaaatcttgcttgaaatcacaatattagggttacaaagcagaagcttgatattcttggagtcagtactcagagacatgaagcagctcagcacaattggttcaaaggaggaaaaataaactaagagattggatctgacagaagcagcaccttcctttctctgttaagaagggaggaaggaaatcctgtgatacatgtttcttatggattagattcagtgcaaatggaagaatgcggggcttttatctttgaaaaattgaccaatattaaaaagtaaatcaaacttgaaaaatctccaccctgtgttttgaattctgtaaagcaggaaaaatactatcaaagcagaaacttcctttaatgtgtcccatgggcaacacaaatataaaactggagacttaaattaggagactgtatcccacttaggggagttcagataagtccttacatgaaaatggccttcttaacataccaaagttttaaattaagaccccataaatgatagattgagagccacagttgagtcccagataaaaaaatcaaatctacaaaaatctaagcataattggaggatttaaagacccttgacaacctagcttgcaattcgtgatcttttggtctgtgaaggcaaatcatatatttaaaaaatacatttaagttctaaaggagactaaaacatgcatttaggaacctaagaatgctagtgtcaacttagattgtcaagttacttaaagtcggctggcgaggtgtctcaggcctgtaatcccagccctttggaggccaaggtgggcagatcacttgaggacaggagttcgagaccagcctgggcaaaatggcaaaaactggtctctacgaaaaatacaaaaaattagacagggatggtggcacacacctgtggtcccacctattgagaaggctgagatggaagaatggcttgagcctgggaggtcgaggctgcagtgagccaagattgtgccactacactccagcctgggtgacagagcaagaccctgtctccaaaaaaaaaaaaaagttccttaaaatcaacttggtctgttgtgtaaatagatgttagacatggagaacatgtgtcttataacaaaactcaatggctccaggcaatataaaaagtattatataaatcccctttaaaaattggtactttggccggtgcagtggctcacacctgtaatcccagcactttgggaggctgaggtgggcggatcacctgaggtcaggaggtcgagaccagcctgggcaacatggcaaaaccccgtccctactaaaaatacaaaaattagccaggtgtagtggtgcgcacctataatcccagccactcagaaggctgaggcaggagaatcacttgaacccgggaggtggaggttgcggtgagccgagatcacgccactgctctccagcctgggtgacagaatgactccatctcaaaaaaaaaaaaagaaaaaaaaaggtacttcaggccaggcatggtgactcacgtctgtaatcccatgtaatcccagcactttgggaggctgaggcaggcggatcccctgaggtcaggtgttcaagaccagcctgaccaacatggtgaaaccctatctctactaaaaatacaaaaaaattagctgggcgtatgcctgtaatctcgctactcgggaggctgaggcacgagaatcgcttgaacccgggaggcagaggctgccatgagccaagatgacaccattgcacatcagcctgggaaacaagagtgaaactctgtctcaaaaaaaaaaaaaaaaaagaattagtatttcagtgcctcagcaccttaacacaaggaaaaagaattttttttttttaaaagaattggtagtgtactttcttactaaaatattttttttttttttttttttgagacaggatctcactctgttgcccaggctggagtgcagcggtgccacctcggcttactgcaacctccacctcctaggttcaaggggggtttcatcatattggccaggctggtctcgaacccctgacctcaagtgatcatctgtcttggcctcccaaagtgtgggattacaggtgtgagccaccatgcctggccttgctaaaataattagtataggcatacctcaattgtgctttagtttattgtacaccatagatactgggctttatataaatggaaggttttggcaatcctgcattgagtaagtctaacagcatatgcttaccttgtgtctgttacattttcataattctctcaatatttcaacctttttcattattattatatatattatggtgatctgtgatctttgatgttactgttataattgtttcagggtgctatgaaccacacccacttaagaccacacccacttaagactgcaaacttaatcgataaatattttgtgtgttctgactgctccactgaccagctgttctctctctctttcctggggcctccctatttcctaagatacaacaatattgaaattgggccagttaatatccctacaatgacctctaagtgttcaagtgaaagagagtggcatgtctctcactgtaaatcaaaagctagaaatgattaagcatagtgaggaagacatattgaaagctgagacaggctgaaagttgggccttttatgcccaattgttagccaacttgtgactgcaaagaaaagttcttaaaggacataagaagtgctactccagtgaaaacaagaataaaaaagtgaaatagccttattgctgatatggagaaagttttagtgacctagatagaggattaaaccagccatgatattctcttaagcgaaaacctaatccagagctaggtcttaactctctgcaattctatgaagggcaagaaagttgaggaaactgtagaagaaagtttgaagctagcagaggttggtttataaagtttaaggaaagaagccatttctataacatacaagttcaggtgaagcaaaaagtgcagacgtagaagctgcagcaagttatccagaagatctagctaagattatggatgaaggtggctacactaaacaacagatttttcttttcttttctttttttttttttgagatggagtttcacttttgttgcccaggctggagtgcaatggcgtgatcttggctcaccgcaacctccgcctcccgggttcaagccattctcctgccttagcctcccaagtagctgggattataggcatgcgccaccatgcccagctaattttgtatttttagtagagacggggtttctccatgttggtcaggctggtctcgaactcccaacctcaggtgatctgcccgcttcggcctcccaaactgctgggattacaggcgtgagccaccgcgcccggcctcttattcctttttttttttcagatggagtttcactcttggtgcaatggtgcgatctcggctcacttcaaactccacctcctgggttcaagtgattcttctgcctcagtcccccaagtagctgggcatgtaccaccacgcccagctaattttttatttttagtagaggcagagttctactatattggtcaggctggtcttaaactcctgacctcaggtgatccatccacctcggcctcccaaagtcctgggattataggcgtgaaccactgcatccggcagagatttttaatatacacaaaacagccttctattggaaggagatgccatctaggactttcatagctagagaggagaagtaatacttggcttcaaagcttcaaaggacaggctgaatctcttgttagaggataatgcagctggtgactttaagttgaatccaatgctcatttactgttccgaaatttctagggttcttaggaattatgccaaatatactttgcctgtgcgctgtcaatgaaacaacaaagcctggacgacagcaaatctgtttacagcatgttttactaactattttaagcccattgttaagacctactgctcagaaaaatccctttgaaaatattactgttcattgacaatgcacctagtcactcaagagctctgatggcattgtacaaggagataaatattgctttaatgccttaacataacatctatttggcagcccatggatcaagaagtaatttaatctttcaagtcttattatttaagagatagatttcataaggctatagctgccatagatagtaattcttctgatggatctgggcaaagtacattgaaaacctggaaaagcacattcctgattcatgggaggaggtcaaaatatcagtcttaacaggagtttgaaagaagttgattccaaccctcatgggtaactttgagaggttttagacttcagtggaggaagtaactgcagatgtggtagaaatagcaagaaaactacacttagaaatggagcctgaagacgtgactgcattgctgcaatctcatgatgaaactttaatggatgaagagttgctttttatggatgagcaaagaaaatggtttcttgaggtgaaatctactcttgatgaagatgctgtaaatattgttgaaatgaaaacaaaggatttagaatattacataaacatagttggtaaagtagtaacagaatttgagaggattgactccaattttgaaagaggttctactatgtgtaaaattctatcaaatggcatcacatgctacagagaaatcttttgtgaaaggaagagtcaatccatgcggcaaacctcattgttgtcttattttaagaaactgccacagccatcctaacctccagcaaccaccaccctgatcagtttgcagtcatcaacatcaaggcaagaccctccaccagcaaaaagattatgacttgctgaaggttcagatgatcattagcagtttttagcaataaagcatttttttttttcttttttgagacagggtctcatattgttgcccaggctgaaatgcactggcatgatcacagctcactgcagcctctacctcccaaattcaagtgatcctcccacctcagcctcctgggtagctgggacgatagtatgccccacgatgcctggataatttttgtattttttttgtagagatgaggtctcagcatgctgcccaggctggtctcaaactcctgggctcaagtgatcctcccgccttggactaccaaagtgctgggattacaggcatgagccactgctctcggccgaataagtattttttgattaaggtatgcacattgttttttaaatgtcctgctattgcacacttaatagactacaatatattgtaaacataacttttatacacactgggaaaccaaaaaattgtgtgacttgctttaattgtgatatttgcttgctttattatggtggtctggaattgaacctacaatatctccacttgtgcctgtacaacatactttatactttggtgtcaaatatttcccttgactaaaattctgtcataacgtattaacatagatgtcgaaatgtctgtttttattctgaagcatcaccaaatacagaggttacttagtcctcctcctctcaactcccattgccctaggcctggcctctccctttcttacacacacacacagacacacacatgcattagactatcaaatctaaaatcttcaaaaattctctggagtcagaatatgtatcaaggcagcagttaagagcaattataatattcattttaaaagaccaagaaattcagccaagtttgaggccttaagtacaaggatgaacatagaaatgacaatgaattttgcctaatagttttcataagtgaatgtctgggaaaaaagaattgaagtttcactctagctaatccagctaagaagatctaaaaggaatcctgaaatgatctattgggaattttactcaggtattgatagagaaatgttacaggaatgtccaagtcaattgtttcttacctgtggagtctagtctgttaatatcataaactgcctggctgtgaaacatccagaagtgtctgttgttgcaggaaagaagacaggaactacatggaacaatcacatgataaactacaatgttcccactagaaaagaaagtaaatgttactagataccatgtaataactagccagataagtcttttcatattgcttatataaatagaccatataatttagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctagaataactttttttctctcagtactttaggatgttgccacttcgacgctttgtcattgacatatctttcctgtttttgtaaacttggcataaagtgggtttcctgtacttgttatatgatttttggattgtgtattcaaattaaaagtattaaattaaaattaaaatggcctgggtgaggtggctcacacctgtaatcccagcactttgggaaggggaggcagaggatcgcttgagacccagagttggagaccaccctgggcaagatagcaagaccctgtgtgtgtgtgtgtgtgtgtgtgtgtgtgtgtgtacacataaatatgtatatatattatatgtatgtatgtatatataagtcctacagtcaccttaagttccaccaacagtgcgcttaaggtaaaatgtgcccaacctgaggctcaaacctacctgctggcacgcaatttgtgtttgtgcgacaatctcaacagcatttgctttttctagcatagtggttttcctgttttcctcacatgtgaatgtcttcagtgcaaaacctgtcagaattcatttcctttgctaaaatgttttaaaataactcttacttcaagtaagtgcattaaaaataaacttctcagttgcatccctggaatccatggaaagtccaggagagacaatcaagtgctacaggatcaagcccaaacagaacaggactaggcatggcttccccactaggagccaggccaaagtcatctcctttggtctccaatggaggccagaactcggttcacctgcaacgggaggacctggcccagaagaggtggccttcatcttcatggtgccttcagataggaaatctaggatttcttttcttctctttcatctacttccaactctccctatttatttatttatttatttatttgagacagagtcttgctgtgttgcccaggctagagtgcagcggggcagtctcagctcactgcacctccgcctcctgggttctagattctcctgcctcagcctcctgagtagctgggattacaggcgcccgtcaccgcgcccggctacttgttgtatttttagtagagacagggcttcaccatcttggacaggctggtctcgaactcgtgacctcgtgatccacccacctcggcctcccaaagtgctgggattacaagcgtgagccaccgcatctggccctccctttctatttcttcaagacctttttctgatccctcctgcgcaggacctaaacgggcggtgcccttacccactggtccctccctgcctgctgtcttcggagccctagctcacccggaacgttactgcccgccggtgacagcgagaggaccaaagagggcagtgggtgcggtgggaaccacagagtcaccgcgcacctgcgcctcgcgggctcctcgcaaattgaataaacgccccctgaagcttctcttcaagtcacagggaaggggaaggtggctgccgacccggcgggagaagccggccctgcccctggtccttgaagacaggtttggccaggctgattttgactggtaggcccaaagaaaagcctcaagggcagaccaaactccgacaggctccgagattaaggctttcaaacgtctgatcgttttcagcttggtcagtaaaatcgatctcgcctttatcaggagattcctttgccaaagttcagagagctggggttccagctgcttgccacacagaaaaccaatcactgagacggttattgccaaggaagaggctttaatagggtgctgcagcggaggagatgagaactcagtctcaaatccatctccctgaccaaccaaaactagaggcttagatggcagggaaagaatgtgacaatgtgtaagaaaacaggaactagaccaggcgcggtggctcacgcctgtaatcccagcactttgggaggccgaggcgggcggatcacgaggtcaggagatcgagaccatcctggctaacaaggtgaaaccccgtctctactagaaatacgaaaagaaattagccgggcttggtggcgggcgcctgtagtcccagctactcgggaggctgaggcaggagaatggcgtgaacccgggaggcggagcttgcagtgagccaagatagcgccactgcactccagcctgggaggcagagggagactctgtctcaaaaagaaaaaaaaagaaaaaagaaaagaaagaaaacaggaactagggaggggcaaggaagcaatcaggatgaatgaggggtccggcatctcattgtctgggtgactttcagttctttgatatcttttttgagaggcctgaaggaaggaactcaaataaaacaaatatcgagtttcaaactttcagatcagaagggtccatttctatgtttatccaaaaatctacgtattggactattgggtgggtttcagaccaagaaagagtgtgcatatcaaagtctgcggttaaccaaagagaaaacataattttccgaccaataggatgtatgggggtcaaagaacgaccagcctacagtactgtttattggcctgagcatacggaaggatgaagttgcaccagcgaaatgggattaagctgcaggtgcgggctgggcgcggtagctcacacctgtaatcccagcactctgggaggctgaggtgggtggatcacttgagatcaggggtttgagaccagcctgaccaacatggtgaaacctcgtctctaataaaaatacaaaaattagccgggcttcatggcgggcacctgtagtcccagctactagggaggccgaggcaggagaattgcttgaacccgggagatggaggttttaacgagccgaaattgcgccactgccctccagcccgagcaacagaccgagaccccttctcaagcaaaaataaaaacaaaaagctgcaggtggaaaaaaaagtctggattttggttcagagcccctggggccttcctcagtagttttctctttctttgaaaaaggaagcctgtctcagtctctgcatctctctgagtccttttggagattgaggatggtgaggtctcagtgcttggcccccttctaactctgggtacctcccctcccgtggtcaaactggtccagtgcacaggccccagctccgacgaccatctcccccctaccctttgctcccagcaaaggccatttctaggtcagtcgtgaggtacagccaggacagggcagctcgctccgagatttttggctctcgaaggccttgagcgctgtggttctgcagaacgctgtctgcctcttgtggaggaactgacacccgctggagaaagtgtggagggaagcgagggctgcacctgcacgcaggatctgaggcaagcggctgttcccagctctcagtgcaaaagacatttgtcatctgagaggctggactcagttattataattttcaattttgtcaataaaaaccgaatggaaatttgttttcttacttgtagaaacctcctcacaagacctcccatcttacattccagggagaattagcagggtattccgccaagacataggttagactgcggttctgatctgcaggcctcgatgccctgcgccagggcaccagggcatgggcaaagccctccccctacacaaagcaagggtgttatgtctacaaccgaacggggacactaagagcccccaacatgcacggttttcattccaaagaaaaccaccagttctgagtacaacttccacctggctctattaactgagtacacgtttccccagcacagaaatcctacaaactcccgtgaatgctgtggtgaaaagcaggagctgccagggcaagatggatcgcacctgtaatcccagcacttcagaaggctgggcggaccacttgagcccaggagttggagcccagcctgagcagaatggtgaaaccgctacgaaaaaagaaaaagaaaggaaagagaaagaaaagaaaagaaaaaaaaagagaaaaaactagccgggtgtggtggcgtgtggttgtcctactcgggagcctgagatgggaagatcgcgccacttctccagcctggacggtacagcgagacttgtcttagggagggggggaaaaaaacaacaaaaaaaccagaggctaagaggtaactccgaggatgacagaaaacaccagagtttttaagagatgttagaagccctgggagcactgaacaaaccagaaagctcccgacccttgatccctgagctccacctagcaagtaccgcggcagctaacctgggagaacaccccaaccaacagagactgaaattcgcctcccaagagagtaagtggatagttctaagctgtccccaaacatggcctcacaaacgaaaactaaccgttgcgaacggaaacaactgaccggacagaacacagccacaaaacacgagcccgcacactgaattacaaaaacacttacggctcacctactattcgcaccacaaaagcaccagaggaaagcgcgaacgcagtcccccactaccacaaattatgcagtcgagtttcccacgtttggggaaatcgcagaggtcagcacatccggaacacaatggataagcctcgccctgagaaaaaccaccttcgtttgataatagtatctcccctgccaggtaagtatgagcttttgcacctccgccccgccacagcctcacacgcttcaccctttacacgcacggtcacttgccccgcgcacccccccccccccccccagccctcctagccctgacacacagctgggactctcaggtccgaccagcggtcctgaacccactcccactgcacgggaactccttagtggcgaagcagcagcccctgcgctgcctcatctacatagaaatcgccctatccgtgatgtcaccgacagcgcctttcccagtccccgtctgctcttccgccccaccctccgccgactcagccgatcaacccgctgccggagctggcgaaggaagtgacgtctgtctctttctccttttcctcctgccattgtcctttggggaggtgcgcagagaccccgcgtctggtctccccctaagactgtggtacttgatctgtgtcctgcagagaacccttctggtggccaacaggaagcttttgcacccttcttcagataatgtcttttaatgcgcagacttgaacgtttaggattacaaggaaaaccggttcctttcaaacctgtttatctttgtgatgtagcattccgcttcaagttgaaagccgttcaatgtcagagagaaaacatatctatgaaaccagagaggctgctcagatgggttgcaaactagccatccttactggttttaccactagaagtgttacaaagacagttgtccaattttatgaatcttgaagggttttttgttgttgttgttatttcaaatacagtgtaatacaaaaatatgtggcccccgcagagacgattggacactctcaggcatggtgatggagtttgtcatctcttccacggccatctcagaaccttagtgcttacctcatattagtattttatattctccaaagacacaaaaataatcccaatttgacaaaacaaacaagcaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacatgaaatggaggggtctcccttggagaccataaagtctgtgacatggtggccagttgggtcactggaaaacatggcaaaatattgaaaatgagggattaggtgagagtgtagcaactgaacactaaatgcttgatccaggtgccattccctggatactgacaggtaatactggaaaaagggggtgggcacagtggctcatgcctgtaatcccagcactccctcaggaggctggcagattgcctgagtccaggagtttgagaccagcctgggaaacatggtgaaaccccatctctacaaaaaaaaaaaaaaaaattagccaggcatggtggtgagcacctgtggcccagctactcaggaggctgaggtgggaggattacttgagcctgggaggtgaaggttgcagtgacccaagcttacaacactgcacttcagcctggatgacagaggaatgggccttcactagacactgaacctgctggcaacttgatcttggactgaccatcctccataactgtgagcaataaatttttgttgtttataagttactcactctgtggtattttgttatagcagcacaactggattaggacatcaacctgaccttaagaaatcatctcaattcagtcttggctctggtgggaaacaagggacacactcggatgtgtgatttaaagagagttgtgtttttttttttttttttttttttgagatggagtctcgctctgctgcccaggctggagtgcagtggtgccatctcggctcactgcaagctccgcctcccaggttcacgccattctcctgcctcagcctcccgagtagctgggactacaggcgcccgctaccacacccggctaattttttgtatttttagtagagagcgggtttcaccacgttggccaggatggtctcgatctcttgacctcccaaagtgctggtattacaggcgtgagccaccgcgcctggcctaaagagagttttatgaagagaatatttataaatataatatggacaggatcaaaacaacccaaccaaggactgagaggcgctcagaatctggaatcagcagagaagttgtattgcctctaggactggattgttgtataagtctgttcaggttgccataacaacctggacaggaccgtagtcctgtccagtgatcctccccaagacaaccgttctctctagtaactatggttttcctttctcatttcaattgtcacctcaattgactgaaatgtgaacaccaactcccgcacttaaatgttgaagccctaacacctactgtgatgatttatgcagctggggcctttgagaggtaatcaggattaaaagaggttatgagagtggtgtcctcatgctgagattaatgccattacaagaagagagacactagaaagcttgcttgtccgccttccccctggtgcacgaagaaatggtcacatgggcacacagtgaatctacagccacttacaggccataggaagagaccttagaaagaaatccactttgctaccacctttatcttggacttcccaacttccagaagtgtgagaaatacacttctatagtttaagccacttggtgtatggtatcttgttatggcaacctgaacagacttatacaacaattaagttgcctttccactgatggacttagacacaatctctttcccaaaaaagagctatatttagctacttttcttttgcatattgttccatttgcagccacactatttgtcttcccccacaccacttctatcaccaggaatccattttccttgttttctttttaatatcgggagcctctgctcactgcactgcatagtccttggggctttttttaaactttatttttaacaatcatttgagcagaaagtagccaattcagttctttaatttcccattttattcttggtttgaaactgacctgattgtgtcccttttgttatgaccagttacttagaagccatacagcccacaaggtacccttgggtataaatccaacttcttcattttaatggtgagaaatcaaaagcccacgtttcctgatttctagcccagcactggaactgttttcatggcatgtcaattcatcatacattttaatagtgatattttatatttgcataattttattgcctttgcaatgggctttcacatctatcttctcatgtgtatatagtttaaaggccatttttacccactatctcctaatcatatcgaccacagcctcaggaaatgtctgctctattatttcacttgcctgtctgggttcttgggcaacagcatagaatcctgtactgtgttttccctcacgctttctcactctctgcagaacaaatttttgttacatgccttattatcatggtaatattggccttcagtcctgtatagaagcattaaaaatgtgcataatgtatatccttttaaaatgttatcctaagaagcatcttttggagttaaggagagttagatgaataaagaaagaatacagtttctcctaaacaaacccactaagaaaatcatggaaagaattatgacaactatgaaaatgaaggaggtatactttgtcaacaaaagcaaaataaccaagctactcttagacataatctcacattatctttctgtagtgctctagcattttctaagccttttcacacactgttatctctttttttctttctccttctagaaattaattatgacttttcctttcaaaaatgaaggactttttttttttttttactcttttcattttttcctgagaccatatgtcaaagggaatgtgaggaacaactttggtgtggtaatagccaaatttctccaggtctgctcctcaagcttgcaaagtcaagactggcagaagtggtgatttttacctgggtatcctgagaaccttgcacagtccttatcacatgcaggtgttcagagtgtgcaaataaatgaagaaatgtgagattgtgatgatattttcatggcatgctttttttccacacttcctcatgcagcccaacatcctctacactgtgttgttctacccgtttaagtgatttaccacttctccattaagccaacttaaaccatgttgccttcaactcaacattgattgatccccaatacagtcctgtagggaggcaagaaaacttacaaacgaagtggtaaagaaagagagagattaagcaatttgccccaaatctcataaccactaggtgataaatcttcaactagaactcaaatatctggctgagaattcagtgctcttttcatttaaatcacattgcttcataaaaatagatctgcaggaagaataaaaatgtccaaagtgcaatgagagagaagataatatggagacagacatattgcacagaaagcatttgaccatatgtctgcctgatccccttcatgtgtcttgttcataacttactttactcgggcagcaggagatagcataacaactgtcagagtgaatttaggccacagttttgtgttgctgaatgtgttgagtcatttcccttagttcacatttctacctaactttatcttttaagtcatcatcatgcctttaatctcttatttattttgactgttgagattttgtagccattatccaaataaaacatttattttcactcgtgagtccctaatccttcctcaatggaattagctatttatttgatgcaatagctagaccagtagggttaaaaatgcttttataaagacattaatagctgggtatggtgatatgcacctagggaggctatggcaggaagatcacttgagtccatgagtttgaggccaatgccttcgcaacatagtgagaccctgtctttaaagtaaaaatttaaaaattaaaagaaaagacatttaaaaaggctgtttaccaaaatgatggttaattgacagaaaatagaaactgaaactagaaatcattgccatcagctttctctaatgtgtacttgatccttttctccctgtgatggaagtctaaagtctttttgtttttttcttaatccactactgttcaaatgagaataaacagccaaatgactgaattagttggtagacataattcctagtcttcaattatttttattttcttttgtaatacagtcattattttttcagacttctataatattgcatttaaccaatccccaaatagggaaatgttatgtaatttttctattatttacagttccttgattataatcttttatttgaaaagattatatatttatataaaaacccagtttctttcttacatataaatattattagtagtctaaaaatgtcactctcaataaacaggatgagtcaacttgaggactagagaatcaggtagtcaacatcagagaactggtttagcaaacagaaggggcctatccagatagagagaagtcaggcagggctgtgctgtgaaaatattagagaagcttgatgggaggcctaatatagtttgtctttacacctgtatattttgcttcttgcatctgcttcaatgccctctgtcatttattataactagatttattgttccaatagatttgtactacagtcagaacaaacaaatcactggatccagcagaagccttagatatatgacataacagagatttgcacaaagatttgccccattgccttctcgaatttctcttatcatcaatccatctagctggagctctctgaaggtcatcagaggtcagtataattttaataagattttaactgaaggatagccttgatgttcagtgaccttcagacatgtttataatcgagaagccactccccctgttgaatgataacctcttccatgaattaccaaaccaatgttgctcacattctgattaaccattgattcccataaacccagcttcccccaacactgatgatctaaataacctgaattatttgcattgccttatcaattccatctcatttcctgtcttggtggttttgctcacactgcttctatgtggaatgtccgtatgtagccactcgagtttccacttcatcgttccatcatctgtagtctctatacactatccatcatcaggactaatgtgagctgactttcctccaaaaagctttccctgaacttatcctgaaataacgtttttctctgctaacttaccatttgtcacgttagtatacagcttctctaactgtcatgaaatgaaataaatgggaagaagatgaaacttgaaaagaaatctgcttcttaaggcaggccctgggggaatagccctggctggaggtaatgtaaggtctagatggtgtttttagaatctgaagactgcaacaccaaacacaagtataagcctaggcaagctgtcagtgcagggcctaaaattaggtatttcaacaagtggatgaatcaatttggggaattgtattagtaaacagaggaagcccgtccagtaaaagggagagtaagcagggatgcaatttaaaactattgaggaaaaaatggctaagaaatagtaaaattaacacatggcctaaaatattaagaaattaagcctgttacagaattactgacctggctagtatataggagcattaacaacacaaaaacagattaggtcgggattagcagtgggggtgaaataatcttcagggctgaactactgagctagaaatatttaaatcctccttgcagatgagaactatagaggacaatttattggttcagcatgaatttctggtcttctgttaagaaatacgctctttcattgaaagtgaacattgaggcagtaaactccaaatacagctgcaggtactatctcctgctgatttgtgtgtacagagcatgaaagaaaggctcagaaacaaaagcatgttggaaaaataagcagaaggaggcatttacttgcaaagaaatgtgaggaagtcattcttcaaaagaactgcccaaaaaattaaaaaaatagaactttttaagacaaacaatattatgaagactatagggtttatattaatctcttcatggcagaaaacagcaattttatcatggttattgtattcagaaagttcatgacatatcttcagacaataaacagctttgtaaagtcaaggataaagtgattttcattaaggagttagcaactctcaggaaatgctcaaggttttattcatttggaggactgcaggtagacagagagacccttttattgtttctttatgtcagagtgcagagtttttttttctctgtttcttcagcagtgggacatgatgaatgggctgacaatggtgtcaggccccgatgtcactttggtttttacacttcatcttgcggtcatgtttccttctctacaggacatgtttgtctacctccatttgctgaacaatgttcttaatcagtactattgattttacattttaatttgatccattttatttgcacagatctaagaagtgttgattaatatttaatgacctcctagtatttttttgatgaaacaataaactaaggctcacaagtttacgtctttctatagatttataaagcccttgtggattaaatttacttttacatgtttaacagctcagtttagagcagaccaaaccagtccgttcacctctacctgatttcatctgcagtatttataatgcaaatgtatcctttttaataaaagatatccaatgtctcggtgtccctgctctgccaagaaaggacattctttcttacctccaagcctgagattgcatagtccatagagcaagcaccagatttgtttcctagaaggatgttataggcatcgcttctgcgtgaaaaacatagaaattattcttattactggatttgtcttgtctaattaaattgaatttgtagcacagctataaattttttattaaaaaattgattcttcctggctgggcaaggtggctcatgcctgtaatcccagcattttgaaaggctgaggccggcagatcacctgaggtcaggagtttaagaccagccaggccaacatggtgaaaccccgtctctataaaaatacaaatagtagcctagcatgatggtgggtgcctgtaatcccagctacctgggaggctgaggtgggagaagtgcttgagcccaagattgagaggttgcagtgagttgagatcacgtcattgcactccagcctgggcaacagagcaagactccatctcaaaaaaaaaaaaaaaatttctaattagtaatatattcaggtagaagggaggacaaattcttattgaaccaatataaataactacatagtcacaaaaagtaaatgtttttattaaagaaactttgtgcaagatttaaccaatattgctaattaagggtatgttaatagacaaaaccaaatattgtatgtcacaattctttacaaaataattatttgtatgtttttcttggcaacttattagctttgtttttatattaagaatttctgcaaggtattttttccctcaacactaagaattcagagtgttttatttagtttttacaaatttaataatttgtaaatttaattggagattaaaggtagattaagaagaaagaaaatgggttgttctcatgttcattaaagtagaaaattaaactaacctcaattaaattgccttactgaggccctttaatcctaaataacaacctcttgtcgtgctggtcttgagttaagcagtctactttcatgaattcatccgcttctacattgtgagtgtcttggaactcctgactcatttacttcgtatagttggaatattgtctgtggggacaaggtcagcctattcttggaggcctatatccatgagtcaatttcctgtggtatcaatagtatcaacagtgtctgctaccgttattactggagctcttttgatatttcttccagatgactcaaattctgattggcgctttgtagagaggcctttaggtatgcttaaagggaaaggagggctgggcacagtggctcatgtctgtaatcccaacactttaggaggctgaggcagacagatcacttgaggtctggagtttgagaccagcctggccaacatggtgaaaccctgtgtctactgaaaatggaaaaattagccatgcatggtggcgggcacctgaatatagctactcgggaggctgaggtaggaggacagcttgaacccgagaggtagagtttgcagtgagctgaggtcataccactgcactccagcctgggcaacagagcgagattccatcttaaaaaaaaaaaaaaaaaaaaagcagcggggatagggggaggagatgttgctaataataaaactgtaaagtttggttaattttttgccatagcaaacgacatcacaatgggggacagtggcattctctgttgaggtgtaatacatactcatctaatgaaattttaatcagtgattaccgtaaaagacagaacacatgaagaacaattagtgcatcccgatacctctccagggcctttaattttccccacaaagtagatattattatttgtcaccaactgataagtttactttttttaatcagttggttgacatttattgcaccagtctttgtacatgaacataaatatgcctgaatccaacctgagaagtgcacaattattgtaacatagccacagtaatcatacataattattgcatttaattaatttaagatgattttattgctattttctcagaatatggccttgaaaaacacagcagcttccactatattgagcatagttttgagccaattaaatatctggagaatgcaaaacattacctttatttctaatatatcttcatgttaagagctaggaggaggatctctggagtttcccagcagccatctgagaaacccagagatactgtattcataaataacatctcagtagttttactattttggatttgagggttaaatttggggaatatggtatcaaaaacagtgtcacaggtgggggctgcagatgtgaagggcctgctatcaatcaggtgaccctggatggactacccactcgctgtgtcagtccaggatcccagctgtagtgggttcctctctgctacagcacatgtttctaaagggcaagaatctgggctcccaataactgacctctgtctcctccatcctggcttgtcatgatagacccgaaccaccctcccattgaatttgggcccttgtggctcatagccacaagggaaattgggagctcacatgtgaaaggcagaattaagttaacgcaccttcttccaaagtcttacgtttgtttgtagcccaggtgcccctgtttccagcaggagtattagcagtaccaggcagccactccccagagtttgtgtttctgagctttcccatcatcagttaattggaaatttcaggaactgtccctgccttacaatgcctgctctgatctacaggtcttttggagacagacagcaggtgatggggcatgccaaagagataaaaatgtcttctgataatcaggggtcagcagatgagtatgaaagctaattatccccactactcagggaatttagaggcttccccttttgtctttgtaggaatagcagactttctgactgtaatgtccaaagttctttacaagttgaagtacagaagagatcagaaaatgtcttacgcacatgagagttgttatccaaagatttgtcataggagcagcgactctaggtgttctctattctatttagaagaattacattagattttgattcctcaatgtggccaagaaatagagctacttgctgggagcaagaaagataacatgacttctgaaaactatttattatgaaaaatgaattttcattatgtagcaaattacactgcagaagtattacaaagaattctcatagacatggtatattaaatctcaaatcaataatcatacatagtcaattaaaaatatctttgttgatatctttcagaacctgggaaataattttctgactttcaaattttttagtttctattcagtggcagaaaatctatattgtgccaaaccagtctgaaaattagtagttgattatatgctggacacagaaaaattttctataacctgttaaatgcaacactccattcattgcttaattctccccaaatagcataaggtaattaaggcttttgtaaacttttttctttttttagaacagcctacagtgacagaggagaatggttatattgttaattaaagctggttcatcactcatgtggtaaacctgactcacatggaaacttaactattttatcacaaagataaatgtttatcatttaaatatgtatgtattcacttttatacttcttgaaaggatttctaggagtacaaagtaaactactataaatctcttttctcccggatggcaatattgctgtgggtgagaaacaatttagtccaggagagctatatctaatccggtaggacactgtggagaatacaagtgttaaatttttgctaaaaaactaatatatggccgggagtggtggctcacgcctgtaatcccaacacttcgggaggccgaggagggtggatcacctgaggtcaggggttcgagaccagcctggccaacatggtgaaatcccatttctactaaaaatacaaaaattagccaggcatggtggcaggcgcctgtaatcccagctactcaggaggctgaggcaggagaatcactggaacccgggaggcagaggctgcagtgagccaagatggcgccattgcactccagcctgagggacaagagcaagactttgtctcaaaaaaaaaaaaaaggctaatatatggagattgatttattattttatcaaaaaggtgacccaaatactaatatgacttttttgagaccatccatttaacaaattgactaaaagactcaaaagttcttttatgttttatgcccaaactaattaacattgagtaaagttagtccaaaaattataaacgttttattgctcatttaaactcattatttgcagctattataagctatagcaaatgaagtttacttccctcagatattctacaattattgtatgcccttaaatttgtattttaaaattcagttttatattctagcaaaactctacaatttgccttttagacaaaattactctctttgccttgataagcaaaaacacattaattatattgcatgcacttttctaaatactcaaactgacttaatttcttaaagtagtataaaagaacatgtgcattaatcagaactaagggtacttttacatactgttcattctcctacttgatagccactctataatgtgtaaaaatatgcagcaaggatatgttaaaaattttatgagacttatccaaagatttttcactaattatctcaatgaaatattagccaagctcataaagctaactagtatgttaaaattcattttaaactgacacactgcagagaatttatactaaaatataaaaatttacatgaaaattgtgttacatatgaaatttgaattttttaccaggtagggtatgtgtggttttacctatacagtataattatttgtagccccatctcaagttacaggaacaaatgttttaaaaaatactagtttaataattcaattcagctgaaccttaaatcgagtaggggacatctagaaagctctggtaagttaaaatattttataaaccagaaaaatatgctaacattaattctaagattgtgataaaatcagagaaaaaacataattaatttaaaccaaaattatcaaaccatatacatttatccaaggatttcccatgattaaaaatattactgaactttacttcagtcaaatttttgaaacgcttcaattttgttctgaagcactgaagtcctttgcgttatgcgattctcttacccgcctgccttcccttgcttctcgccttctgacatagcaacaaagtccattaattcacctcagaactaaacctctctatagattttttcttctgagctgcagttcagcaagttacctgtgctagtatacataagccaaggaaaacagaagctccattaaacttaagaaattgtttaacctaactcattaattttctccagagataggaaaatgtacaataatttgttcagaagatatttacatacatacaacaagaagtcattatcaaattcggagccagtgatgattttctccctgctttattgtagactttcatatgctatttatttatagtccttatccagtcagattatagattatggtagagacgtaatttttgaggttgagtaatactttactgttgatgtatagaatattcctcacaacttattttaactcatttttatatttctatgagattttccttgtttggggttttttgtttgtttgagaaaagggctagagaaatttaaatgcttgaaaacctttagagttttcagaagcacccagaacttcaaagaaacacaaagctattctcattaatgctttcttaagacaaataaagcaaagccctaccaacagttagagctctccatttttcaagctatgcaagattgtctccaatagttatggcttcagcagtggttcaacttgagtgtgcatcagaaccacctgcaaagcctaattaaacggattccttggctcacttggcagtatatgactcagtaggtaagatttgagaatttgcatatctaacaagttgccgggtaatactgataccgatgtctagggactatgagaatcactaacctagagtgtttaaaaaatgaccaatttctgtgcccaattatctgccaaagtttcctaagagaaggaaaacaacaacaaacaaacaaaccaaaacagagagaaactgagagaaacagccacaactggaaactagtaacacaaaaacaaaccattgtaaaagctaattaacttattttcataccaatggggaaagatttttatttcattttggacccacaaaaagctttaggagttttttcatgtgccagaaggaagcacataacctccaaattcacaatctattctttgcccgtttgctgtagttactcttcgtaccaaaggttctgagtctggagtctctgcttccactggtcagatagactttctccttacattgtggtctctcactgaatgttctcacccactgcttcctcactacgtaatatctgcccaagaagctcccgtcttctcattctcccatcccatatgctgacattctttccagtccctgcattgttatgagagctcagtgggggagggagctgaatgtctgtattcagtccacaactacgatctaggatactctgtattaaccataaataattgatgcaagtttcttccactcagccatagctgagccagattacccgcaatgctatctcatcccaccacagtctctacgactaatttctattatgcaaggtaagatcaacatttgaagtgattgagtttaaacataaaaagatgtattggctcctgtgactgggcagtcttcagggttagttgcttgagtgatcaatgataccattaagattatgattgggacatgaaaaaaagaactggcaaataaggagagaactttgaccatagaaaggcatttaatccttgtgttgttttgagcgccctaaaggaaaagacaaattaaaggcagatcctaacagaactattaacaaagaaggaagagggtgaatgagactcttgaatcaaaaattcttaattcttaactccacctgtgaaatcttacttaatctggttatactaagaataatcatcacaccattctgtctcacattctagaaggctttgtagtggtagaactgtaaacaatatataaacatttctgaaatattgtggttgttttatcttccataagcctcacacaagccgtgtgtatgatcatccatcttctgggccattatctgattattgctgctatctctcgctttggggaaaggagagtctctttccttatcaatagtattggatcagctcttctaatttcatgatgacatgagtgttcaggaatgatggaaggcaaatgtaactctgagaaaactttgtttaactactgcatttcacaagtccatatccatcctagaagatcttccagcctgctctctgccttgctcccaagatggccacatgtaggtctcttctttcccgtaaccagagggttatagattatattatctttcaaagtctgggataaaccaatttctcactctaaagagaacaacgtgttttgatttttccaaccctaaccctagcctaaagtctaccttctaatcctatctttattataaatgtccctggattgatctttcaagggatttttgcctactgaaaaaatattactctcactcaaagaattgtggcctgacaagaaatctacaagagtcttggacacagaggccaaaacatcataacgtctggattattcaggctaaagtaatatcacctgtgggttacccacagcccagtcctcagcttcagacaatgccggagtcactagtgttctgttttctttcctctatcattcctattcaaaaattctaaaaatttggagttccatttctcttaagaagacatgaatacattagtacagtaacatatttatctctacttccttgaaattttattgagaaatccatcattttccaaacttttctttctattggtgtaaaatagggatgaatggccatgagcacttcattgcctcatctcaggtgacacttttttgccctttgaaaagcctataatgtactttataatgtagtttaacttttccacttcacctcatgtaaacaaactgattttccaacttatcaatacagtatgaacatttctccaagtcaattaacaaaaagaggaaatatcactttaaatgaatgcacagtttctctatatagagaaaaataatatgtgtgcatatatgcatgtgtaaatatatgtatatgactaaattctacaagtttttaaactatctttttactgatggagactcatcatgatttttttccccctgtactacaaacaaagtagccataaacattctaacattctggagtatggtatcccttatatgaaatgcttgggaccaaaaatattgtagattttggattttttcaaattttgaaatattttcatatcataacatgatatgttaagaatgagacccaatctaaatttatttacattccctacatatagtatacatgtagcctgaaggtaattttatgtatttgtaaaattttgtgcaagaaacaaaattttgactgtcttttggctgtgaccagtcatataatgtcatatgtgaaatttttcacctgtggcatcatatcagtgctcaaaatgtttccaattttgaagcatttcagatttcagattttttagttgaccttggaacaacatgggtttcaactgtgcaggtccgcctacactggtatttttttaaaaaaataaatatatcagaaaaagttttggagaattgcaattgaaaaaactagcagactaactgcatagcctagaatataagaaaaaaattaagaaaaagctatgtacatcctgaatgcataaagtatatgtatatgttaatctattttatcatttactaccataaaatatacacaaatctattataaaaagttaaaacttatcaaaatgtatgcacacaaaccgtacaagtcactatttgcagtcaagagaaacataaacaaacataaagatgctgtattaaaccacaactgcatacaattaactatagcacatactgtactacccaaataattacttttattttatttttataaatgtgctaggtacaagcatacttttattatatgattgttttgttatttggatatattgctagtggtgaagtctgagcttttactgtactcatcaccccaatagtgaacattgtacccaataataatttttcaaccctcactcccctccaaccctggcatgttttggaatattctccagcgtctactttccagtgtatgtactattataataattttgtagccaccccctgttgctactgtggtgagctcatgttgccagtatctgccatgagcacttggtctcttcagtaaattctgtatctaagtaaatagtgtgttctttcacagttctcttttcattgtgcttagtgtaatactataaatcttgaataacaccatgagaccaatacaaagtgccacaagtgatgctgggagtgctcccaagaagcagagaaaagttgtgacattatgagaaaaagttagattgcttcctatagattgagttcttcagctgcctgccatttcaaaataaatgaatccagtgtaaggtcccttaaaaaaaaaaaagagaaattcataaggcctcatttcgtgccaacaggcatgaaaaccttgtcctttcttatctcatattcaaaatgcagcttttatgtggggtacagaattgctataagaaagacatacctatagactcttatttgattcaagaaatagcgaagtcattatttgacaacttaaagtaaaagcaaggtgaaagatctaaagctggagaatttaatggcagcaaaggatgatttgataattttagaaagtggtttggttttaaaaatgtcaggataatgggagtagcaacttctgccaaccaagaaccagcaagtgaattctcaaatgccgttaagaaaaacattgaggagaaaggatatctgcctgaataggtattaatgcagctgaaagtgccctattccagggggaaaaataaaagccacaaaggtcatttattagtaaggaagagaagcaagcaccaagatttaaggcaggaagggataggctaactctactgctttgtgcaaatgtagtcgggtttatgatcagggctgcccttaactataaagctgctaacccctgagtcttgaaagggaaaagagaaacactagttgccagtcttttggttgtacaacaagaaggcgtggactatgagaatgctttttctggattagttccatcagtgctttgtccctgaagtcagaagtaccttgccagtaagggactgctttttaaagttttttgttgttgttgtttaattggaaaatgccccctggccacccagaaccccatgagttcaacaccaaaggcactgaagtgttctccttttcccccaaacacatctctacttcagcctctagataagggagtcataaggacctttaaggctctacatatggcactctatggaaaggtttgtcaacattgcaaaagagaaacccaatacagagaacatcatggaagtctggaaggcttacacctttcaagatgtcatcagttgatatagaaaaccatgaaactcaaaacaataaattcctgctggacaaaagtacaatttgtgtccagatgttgtgcatagctacagaattacgacaaacccaatttagagaaaaccatggaaagaagtatggatatgaagggaaaaaaaggtgtggagtgaagggttgcaagatatggatcttggaggaatttaagagctaatacacaccacaccagaggaattaacaaaagatgacttcatggagatgagtgcttcctaaccagtgccagataatgaggaagaagacataggaaaagcagtgccagaaaacaaattggcattcaacaatctggcaaaagagctttgattattcaagactacttttgacttcttttatgacatagaccgttccatgatacaggaactgaaactaaagcaaatggtggaagacggataggtactacactgaaatgtttttagagaaatgaaaaagcaaaatagacagaaataatgatgtatttttgtaaagtttcaccaagtgtgcttgcctcttttgcttccccttccatcccttcaccctcttccacctctgctaccctaagacacaaagaccagctcctcctcctcctcctctgcctactcaacatgaagacaacaatgatgaagacctttaggatgatccacttccacttaatgaatgggtcatatattttctcttccttacaattttcttgattataatttcttttctgtagcttagtttattgtaagaatacagtatataatacacatagcatgcaaaatatgtcttaaatgtaacgcatgttatcagtaagccttctggtcaacaataggttattagtttggggggaatcaaaagttgtatgcggatttttcactgtgtgggaggccagctcccctaaccctatgttgttcaaggggcaacaatattctttctcactggcactttactttccataaattcaaatcccaaaagtagaactgcaagttcaaaaggatttttaaaaaaataattactgtcagattacagaaagtttccaatttacattttcactaccaatgtacaatgttggcgtccctgaatccttatcagcaatgaatttttaaatatactataagagatgaaaaaaatttttttaaatttggaattccctgatcactaatgaagttaagcatcaatattattcctttaatatgcaaatgctgaaaatacatttaactataatagatgtcaaaaatctgtaaatcaggctaggtgtggtaggcactcacctgtattcccagccactgggagacttgagtccaggagttccagactgtagtatgcaatgatcaagcctgtgaatagccactgcactccagcatggacaacatagcaagaccccatctttttttttaaaaaagagtctataagacaaaggtcctcataaattaagagaagccaagacagtcactgtgactgcagaatattttaatttttttttattatattttaagttctagggtacatgtgcacaacgtgcaggtttgttacatatgtatacatgtgccatgttggtgtgctgcacccattaactcatcttttacattaggtatatctcctaatgctatccctccccccagccccccaccacagagcaggccacagtgtgtgatgttccctttcctgtatccatgtgttctcattgttcaattcccacctgtgagtgagaacatgcggtgtttggttttttgtccttgtgatagtttgccgagaatgatggtttccagcttcatccatgtccctacaaaggacatgaactcatccttttttatggctgcatagtattccatggtgtatatgtgccacattttcttaatccagtctatcactgatggacatttaggttggttccaagtctttgctattgtgaatagtgccgcaataaacatacgtgtgcgtgtgtctttatagcagcatgatttataatcctttgggtatatacccagtaatgggatggctaggtcaaatggtatttctagttctagatccttgaggaatcaccacactgtcttccacaatgatttaaccagtttacagtcccaccaacagtgtgaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatacttctcccacttgttgttggggttgtttgttttttcttgtaaatttgtttgagttcattgtagattctggatattagccctttgtcagatgagtagattgcaaaaatgttctcccattctgtaggctgcctgttcactctgatggcagtttcttttgctgtgtaggagctctttagtttaattagatcccatttgtcaattttggcttttattgccattgctttcagtgttttagacatgaagtccttgccatgcctgtgtcctgaatggtattgcctaggttttcttctagggtttttatggttttaggtctaacatgtaagtctttaatccatcttgaattaatttttgtaaaaggtgtaaggaagggacccagtttcagctctctacatatggctagccagttttcccagcaccatttattaaataaggaatcctttccccatttcttgcttttgtcaggtttgtcaaagatcagatggttgtagatgtgtggtgttatttctgagggctctgttctgttccattggtctatatctctgttttggtacaagtaccatgctgttttggttactgtagcctcgtagtctagtttgaagtcaggtagcgtgatgcctccagctttgttcttttcgcttaggattgacttggcaatgcgggctcttttttgtttccgtatgaactttaaagtagtttttttccaattctgtaaagaaagtcattggtagcttgatggggatggcattgaatctataaattaccttgggcagtatggccattttcacgatattgattcttcctatccatgagcatggaatgttcttccatttgtttgtgtcctcttttatttccttgagcagtggtttgtagttctccttgaataggtccttcacatcccttgtaagttgggttcctaggtattatttcaaatattattgtaaaacaatgagatattgaaacatacattggagcaaactcttcttcattcttaaatcctttcagcacagagacaatcaactgactgtctgggtactacctgaccactattggagtctctttcatctgcctgagtctgtgcaacaatatgaaattataattttactatgcacctaaactttcctcaatatattgaattcttacagaatttgaagagtcaaattttgtaaatccagttacctttttccactactctaggcctcatatactatctggcctaagggttaaaggtccacaattgaataagccaaacttgttaatttgagggtaaagcatgtcaagaaatctggccttaatgtccaatgaacttatgtcatattaagtagctggatagaaacatgcattccaaagtggatactgtttatcaggctcagtgctctattcttgacagtaaatcccagaatagggtggatgctttaattttgtattaaatagtattaggtgtaatatcaaaaccactaagggaacactaatgatgagaataggaacactagctgtggagctggcaattttctatagaaatcctatctctttcaattgcctgtttagtgggcaagtgtttcagttcctataatatctaaattggagaaaatcaccccacctacttcttcaggtgttatgataattatgagggataacatctttttaagtgtttaacacaattcctcacacatagaaagcaataataaacattggctagcattgtaaggatggattattgtctttcaatgtgttttcatacattttctttctgggatcttgagtgaaacatgtggatctataacaagaacaaaatgatgttaccttgatgatctctatgtagggtcacactaaaggcatcttaaaatattttgctggccaacaaaagacacctcctgttctaattgggcattgtccttttctttaaactatgcagacaaacaatattataaagtgagaacatccacataaaaaacctaaacataaatcttaatagtgagttcatgaaaattcttactgatgaaatggcaatgtcacagactgactgtttatgtccccccaaatttgtatattgaaatcctaacccccaaactactcgtgttaggagatagagccttggggaggtgattaggtcatgaggacaagattctcatgaatgggatttgtgcccttataaaagagatcccagagagctcattggccccttccaaagtatggggatacagcaggaagttgccatctatgagccagaagggtgaacctcaccccagatgctgaatctgccttgatattggacttcccagcctgcacaactgtaagaaatttctgttgtttataagttactcagcttgtggtattttgttacagcagcctacacagactaagacaagtagcattttgaggattaaaatttcttcataaatgaatagagtatgccctgttaaaccatattctcagctaaccccatttactcactgttcctctttattttagtttcacatttttgctatttatctctgtaatttcattcaatcttcacaatttgccattcttatacttcgaatcatgttatcagtttataatacctccatcaaatgatagtctgcatttgtttatccttggctgattcaaaacacttggcataatttccttaaaggaaatcatcttcatctcacctcacaacactgtattattttcaattaatttccaataaactcttaattgtccatgctctgtcagagttggcagagttaatccctgtttaagctaataggttcaacttcttcaacaaacaaatctggctgctgacaagccagagtattaattaaatctagtttcattgcttctcactttccttgatctttctctcttgttctttgggaaacagtcacagagttctggcgctaataaatactataaaaagtaggaaatacagtctaaagaagcagaatattctgtttaaagttgatgtggtgctttttgtgcaccaagcattggctcaaaagcctgaaaattaggcagcaatacttcctaagctcatcttcaaccataaggcagaaaagccaaacatatctgaaaatataatatcactggtaccttataccagcactaagaataagaaaaccctggaaagtggctcaagtacaatatttttctattggaattaatttttcaaaatggaaaggacttcattgttatttttattataaaattagtatatgtttattattaaaaataagtacaaaaatctctaaaagaaaaagggaaaaattaccagcagttccacattccagatatcatcactgttagcatttaggatacaaatatccaaacactttttctatcaatacatttaatttttaaatttgaccattacgcaatgtacacatgcactaaagcaccacactgtaccccataaacatgtgcaattattatgtcaattaaaaacaaaataaaagcattttacaaaaaatcatgttatttttaataacttgtttttctaattttatacaccataaaataaatgtctttacatgacatttattttatgataataactaatttactcatttaaacagcaaggtacatttcattctacagatatactatataatatttactctgatctctggatgagaatttatgttgcctgtaaatattgtatcacaaacattataagaataatctctgtaaaggtttttttcctgtattattatttgggtagaaaaattactagaaatagaataactgggtcaaagattaaagacaatttaaatttcaatatatagaatcaaattattctccaaaatattgtactctacagtatttgaattttgatttttttctccattttcactactgccaataactttaatctttgtcgataaatgagacaaaaaagacgaataatgcaatattatacaagggagattaataggtagaaaaagaaatgtaatggccaggagtaacagaagatgttcaacatcaatccaatcaaattagtctttaaaatgcaatagcagtcaatgttagcaagagtgtaggtattagacattctcataggaatataaactagggccatgttttaggatcatattagatcgcagcaattaaaaaatgttaaattcatatgttctatagcaacttttcaggttggaatttatcacatggagaatcttgtaaaatacataaaccaagatatgttattaatgttattggtagcctattgtttaaataaaaaatatatttatacaatacagttgttaaaagttaagaatatcttgaaggtaaattattaaacaaaaatagaaagcctaggccaggcaagacttcatgtcatgcttgtaatcccaacacttttggagactgaggctggaggattgcttgagcccaggagtttgagaccaacctgggtaacacagtgagacctcatctctagaaaaaaaaaaatacaaagcttagttctgaacatccttttgtgtaatactaaaagataaaattttattttctaacttgtttaagatctatattctatacgggggatgtgtattaaggtcatttttaaaaaggtactcaagaaattgtcaacagtgattatcttaaggagagattctagatgtctgggggtaagagactagaggaaagagaattttatatttcatttttacctttatttaattttttgattttcttactgggtgcatgaattatatttttatgtcagcatgttttatcagataaataaaattatgagctatttctgttttctctcatttgttttatgtttaaataaaggaaaatgagatatgtctttttaaattagataatcttgagtccatgattattatgaaagccctctgttatctttttccttcctttcacaatgactatttatgttgtagaatcattaatttctcaagacaaatgtcttagaaggtagatacaaaaaaaggtatacattttttgattcaagctaatttcatgttatgaacaaaattacgtaatgtcatttctaagacctttctgtgatctatcaatccactaggttaaagagcagaaatcacttccaaaacaaatccttttgcagtcagcaaaatgaagcaattatatgaataagtttttccacttggcctatttttctacccagggttattaatcagtctcattgactacattttccgttttacatcccctttcaggcactactgcagatggccaagcatatcacattatgtaaataaaataaaacaaaatcttctcccattgagcaaatggatatacttcacctctaatgcttccagtctttctcagatcattcaaaaagcatgatatggtttccataaaaggacattcatcccatttgactaactggaatttctttactccagctaatctttaccaaagagctgaattaattcaagttgacaccctgttatctaccagctcttccagcccttttgcttgattgttttgtcattttgtcttttcttttcttctaaagtgggagtatggagatttacccttctgaaacagctgtgtcacatcatgatccttgaggatatcagctcttaactggctgcacatcaaaatcactgtttcctttgaccaatactctagacacactcaagcagagattctggattctgatttaattgacacagagtagggcctgggcatttttacagctccccacatgattctattgtgcctcatctatcctagcccttaagcaggaccaaacatttgttctatcttaattattattctcttaaacttagtccaattccttacaactgatagctttctatatactcatctgccttgagtgatgacaattgatatggtttggctgtgtccacacccaatctcatcttgtagctcccataattcccacatgttgtgggaggtgcccagtgggagataactgaatcatgaggatgggtctttcctgtgctgttcttgtgttagtgagtaagtctcatgagatctgatcatttttaaaatgggagtttccctgcacaagctgtctctttgcctgctgctatccatgtaagatgtgacttgctcctctttgtcctccaccatgattttgaggcctccccacccatgtggaactgtaagtccattaaacctctttcttttgtaaattgcccggtctcaggtatgtccttatcagcagcatgaaaacagatgaatacaacaatactgtaacaaattgactcacatctgttctctttataggaattgcaatgctacaatattagtggctcttaattctaagagtgttaaaaaatattaatgcttgtctcacccctaaagtctagggtgtgacctgagtattaggttatttaaaacttttctcaggtaatagacatgtgcagccaaggttgagaaccactctatagggccaagatatgtaagaaaattcaagtcctttagctgggcgtggtggcacacagctgtagccccaggtactctggaagctgaggtgggaggattgcttgagcccaggagagagaggctgcattaagctatgatcacatcactgcactctagcctgggtgacaaagtgagatcatgtcaaaaaaaataaaaagaaaggagaaagaaaggaagaagaggaaggaaggaaggaaggaaaagaagaaagaaagaaaggaacaaagaaagaaagaaagaaagaagagaaaaagagagagaggaagaaagaaagagagaaagaaagaaaagaaaaaggaaggaaggaaaggaagaaagaaagaaaaagagagaaagaagaaagaagaaaaggaaagaaagaaaggaagaaagagagaaagaaggaaaagaaagaaaattcaagtcctgccttgtaaaatgcagtactccattttcccaaagagatcccaagggaaacttaactacaggataaagacaaacaaaaggacataaattacaactactctaggttcacatattattttgtttctgaaattggttttaaaatatctatgtcagagttcatttctagaactttatctctagaaaacatattttcacttctcaatacaggaaaatggagactggaaaaatgaggttggaaaatgatttccatgcttatctctcagcttcttttttcaacttccctttttcatctccgtatcttcactgatacctaggaatctctgttacatcacagtcttcaagagctttgcttgcagcaaattagttaagacattagctttcaaaagtatatgatattctctcacaagcatttgtctacttttaatagggcaagctacgtaaagatgttaaatctcattccagaaataccacatctactctacctatttatgagaacagtcgtctctagaccaagatagacattcatagttaggaaataaatccctgtaggctttttccacagtcccaatatgtcccctactgtcccgattttagcaacaaaaatcccccatccagaaaatccttcattcctgagtaagttgaaagattggtcaccctatttctatctgtgtctctttctttcataattggctcataatcatagcagtcacaattttgaaaaattttattttactgaattactcattgctgttttctcattttttaaataataaacacttattaagaaacattggaaatataccgaaaatagtaaacaataaaacagaaaccattggcagaaatagtcactattaaaatcttaatatactcccttccaatgttgtttctgttaatgcaaattaaaaaatcagagattcgcctctgtgaactagatctttttacctttagatattatttgacaaatatatagctcgatcatctatccaaacttctcttttacagactccatgccaattaaccttctcctatgaaactattatttcttcacataggataaatatggtttttgacacacaaactttcttagttacactgcaatccagttgtgcatctctaaatttataccaattggatttagaatgatcattactaaagaggcttggtcttatctcttgcaatttgcttcttccttcttaaattcaattcttgtaatgtaactataatttgggggtattttttgcctcatattcaaattctctttcaaactgaggtacatttctgtatttctgtatttgtatattgtatataatagtatagaaaacaataatgagattatagtgtacataaaagttttgaattataattaaatatttaatatataaatatattaaatatgtataaaatatctgattagtaataagataataatttaaaacctctgagttttaaaactaggactttgaaataccagcaaaggccacctgctttgaccaacatctcttttccctgcctgctttaatcatgtcttgggtcctgacaaatttgcccccagatccctcccaaattactctccaactctgttctatgtttcaggaaaataacatttatttcccagtctcctttgccctccattttcccagtaggctatccagtgagagatgccataaaagcctgcctcttctctgcagggctgcttcccaccagatagcccctccctccatggacccaattcccattagctctagcaacctgcctgaagtcctggccccttggctctgataataacaccttcttccatgatccttctagtcctaggggcagtactggtttcttgctcttgagctgctgactcaccaagcctggtttggcttccatcacttgtgtaatcaatcacctgtattaaatcacctctgcttgaaagacgaagaatagtttctgatttataagcaaacactgaaagctcttctatttcttgtttgctaaacaagatttgtcaaagttaaatattttattttattgaattcactttttgcctcttctacaatgatgatttgcttttcctcctttaacttgttaatgtgatgaattatacatagttttttttctattgttagaaatccttgcattcatggaacaaacacaattttcatactatattatcttttttacagatttctaaacttaatttgctaacttttaatttaaaatgtttgccgttaggttcatgaggaaagttggcatgtaattttcctgtcttacacatttctcatataacattggtatcaaggttgtactggcctcataaaatgaacaaacaaatggacctttttttattctggagttgtttttataaaatggaaataatcaatttcttgaaaacatttgatagaactcaccagtaaaaatgtctgggcctgctggttctcttcttctaagaagaatttggaacttataattaaagctcctttaatgtgttagaaaactttccaggtttccttgaacattaataaattccaatgatgaaaagccctcagatattaaatataaccttaaatataaccttcccccaattcaatttttcttttgcagatatgattagatactctaatttttcaacctctatttcacctatccattttcctttcctcctctgtactgtcttcagcataatttgtttagtctaacttccaactcacttattttctttttggttctatccaatattgtgtttaacctgtccatttagtttttaattttcattatattttttatttctaaaagatctcttaagttcagtttcaatctgcttaacataagatacatacactgtctcaatttatattcctggcacacctcattgattttttaaacctattaaacacagcttttatagttatataatcatcctaatatctgaaatctttatgggcataattctgtttctgctcatgatgtttatttcctcatgagttttgtaagagtcttacttttttctcattttggatgaaattttacctgtggccattctttgagacatgggctgaatgtgggtttctccaaagacactttgccttcgtcttgtgtttggtggtaataccaacatgggataactataaaataaattatcagtttcatgtgtgggtttttttaaaattatacttacagtgaaaatttaaaccacaaattcatgtgaagatggccttctaatttttcctctaaatagcaccgagtttgaggcaggaaaatttcctggttgtctccccctgaggaacaggtttttatctagtttatcctttcactgaaattatagtccttcatatctctggctttcagcagttttctcctgtaagactgctatactgggcaggcactaggttttgtctcacactctcccatatcccaggtggtcataaaaattgaagctcagggtactagggccaggactgtccttatggaagcttctggtttgggggtctgcatacctctctggatttatgtattctccttatgcttggcctatgtggttcaccttaatttctattcaagtcagtaatatacttttgaaaaatgacatgtacattttatctggtatttgtagatttcatatagcaggatagtgattcaacaaatttagtctgtcacaatgctaggaatagaattcccctaatttttgaaaaaattatatcaaatcatgtttattgccattaatagtcttataaatgtgcttttaagtaactgcattttgtcatagctcattgtgattgtatatttaactaattcacccctacctcatgttttttgggagtgaaggttgtactcaactcattatgttaagtaatactacagtaaacatcaatctatacatgcattaataatgatttccaagaaagtagtgacacatggtcataatcatctttgaggctgatggtacatattttcaaattgcatctcagaaataatataccaatctgtgctctaatcagccgcatatgaaagtgtcatctttctgttctccaaccaatacaactactactgtttttatacctacaaatctgacaaagatgggagaaggtatcttatagtttcaatttgtatttctttggtgaccaatgtactaaattactcaatgtactaaattactcttttcctgtttatcatccatttcaaacaagatgtaaaccattttaaatttttttatattaatgcaaatcgtaaatcactactttatttattcaatttcctaagcaaaattatatgttgtcccatttatacattttatattagatcattctgccttacatttatatcctaaaaactgtcagaattatataataattatgaacagttgattataaataatgcctttattaggatatttctccataaatctaaatttcatcaatctttctttaaatatctctacacaatttcctcttgtattatattaataattgcagatacacttctttttgctatttctattaattctttcctattcctattgtctgttagtctcccattttctcccataaaataaataaaaatttttctatcagattctgtgatatattacttcttattcccagccttcaacattttaagaattcagattgaccttttctcccattcttatttcaagttatcagcatgtcaatacttgggaaatcccatcaagtgtttaacagtgcataccttactgattcattatttatttcaatttaatctttcttattttcattcaacttttttctcagtaatacaactttttcaagctttttattttctaatgcatttctccaaatagcagccataacccttatatgccctctttcaatgacaacaacaaaagtgtgctaggcttcttggaagaaaataattataccaatttaagaaggagaaaattgatgtactgataaacaaatgggcatcttaggatcatgtttctcacaagtaaggcagttccagaaattcctaggaccctaatgggttttattctaaataggttaaacatatcacttaaaaaattgttttctacagttctctaatattgcttacaattgtccacgtttccatgtttataaacttgcacttttttttttatggagttttgctgttgttgcccaggctggagcccaggctggagtgtagtggcgtgatcttggctcactgctacctccacctcccaggttcaagcaattcttctgcctcagccttctgagtagctgggattacaggtgcgtgccaccacacctggctaattttttgtatttttagtagagacggggtttcaccatgttggccaggctggtctcgaactcctgacctcaggtgatccacccgccttggcctcccaaagtgctgggcttacaggcatgagccactgctcctggccttatacttgcacactttttaattctaagaccttgctactcagtgagggatcctgggactaataccatcagcttgacttgaggccctctttgaaagcagactcagaatctgtaatttatcaggatccccaggtaatttgtatgtgcagtctagtttggtagatctgctctggcagactggaagactcttctatctgcctcacgtaaggtgcaggtgacataattaggtaatcaagcaaaagatcacatattttaataagaaagagacactggctattattttgagtggcaaaacaggttattcagtcccagtttaaaatggaaatgacagagaccaagatcaagatttttaatttgagatgtgcctgcgatgcaattacatttgctgaatgaaactgcttcagtaattagatgcaggtttcttctctcttctttttgagatgtaaagaagacacaatagactcatggaacttaaagaactagacaccagctaacaaaacatgctatccagactcttccatttcaccatattgctttcttgaaaacataggacagtgccagtttagcactgaaaaaaatcagttctcctaattctaaaaagaggagacagccaggcgtggtgggtcactaaacatacaaaaaattagcgggcatggtggtgcatgcctgtaatcccagctacttgggaggctgaggcaaaagaatcacttaaacccgggaggtgaaggttgcagtgtgctgagatagcgcctttgcactctcgcctgggcaacaagagcaaaactccatctcaagaaaaaaaaaaaagaaagagagagagagaaactgtaatttcatttcagaagttttatagggtactatttccaattctttttttcttactccattaaagtgtaattagcagtatgtgaaaatttccactttatcctcaatcagaagcctctccttccaattagcatattttttttctattaactttgtaaagtgggattcttgttttatacatacccctggaaagtatacttaaactgtgagaccctgggattttatatttccaaatagaagataccatcctcttgtatcacaaaatgtatctaagatggtttggattatatttaaatattcttgaatgaaatagacttactgactgaagccaattattagatttttccacaccaaaataaatgcaataggaaaagatgacagttctatgtagtattcctgcttccatattgcacaaattagaaacatacatattctattatgttacagggtctagggctttgggaggacaaggctgcaggcagccgagattgtgccactgcactccagcctgggcgacagagtgagaccttttctcaataataataataaaagtaaaaagaaatataatatttaatcaatatatgcacacacatgggtttatcatgacacacatgacatgtgtgtacagtgaaaacaatgagtaaatctagaaacctgtattgcctcaatagctagctaagtacttcaatatgcatgtttatttcaacaattttgtgttaagctttagtggtaaataagcagagtacactggccataatgaatactccttttgatgagggttatcactacacaattaaaatattacatagttggctgggcacgttggctcacacctataatcccagcactttgggaggccgaggcaggcagatcacctgaggatgggagttcaataccagactgactaacatggagaaaccccttctctattaaaaatacaaaattaaccaggcgtggtggcacatgtctgtaatcccagctactcaggacgctgaggcaggagaatcacttgaacctgggaggcagaggttgtggtgagccgagatagcaccattgcactccagcctgggcaacaaaagcaaaactccgtctcaaaaaaatatataataataaacagatatatattatatatataataaatataaatataatatataatatatattatatatataataaatatataatatatattatatatataataaatatataatatatattatatatataataaatatataatatatattatacatataataaatatataatatataatacatataatatatatattatatataataaatatatcatatagatgatatagtttagagttaaatactgactgctcttgggaactttgaggtattctgagggatataaataacacgaagagaatagcacattggcttgaagcagattagagtctgctacctgcgtgaatacttgcttttcatgaactatgaggatgcccttagcttttgaaccacttctacttgtgttgaaatttaccctttaattttggggtttgacaggctctgcccttctgttatgcttgagtctggcttttcctactctgactcactttgattcttgacctctgaatcttattcctattttacaataaacacacatcgcacatacgccaattagtagagtggaagagggaaaaattgccaaggaactatgtttaattttgttcctttcgcaaaccagacaccataacagaaaaattttaggaacatgtgcatgttcagtagccttcaatgcaattatactggttattaaaaagtgttggataatcaatattttttaaagattcactagtcccttctcataattttagaactttgggaagtaataatacaaatgtatttttagctgtgtcctttaatcttttactgtttcctctatgtgtggtgtttggtttgtgtgtgtgtgataattattataaagatcagaggctaacagaggtgttaatcacgaacttttaaatttttttatttttatttttttattttttttaagagacagagtctcgcggtgttgccaaggctggatgcagtggcgccaactcagctcactgcaacctccgccttcagggttcaagcgattctgctgcctcagcctcccaagtagctgggactgcaggagggcaccacgatgccccactaatttttgtatttttagtagagatgcggtttcaccatattggccaggctggtcttgaactcctgacctcatgatccgcctacctcagcttccctaagtgctgggattacaggcgtgagccaccgcgtctggctgcatgaccttttaacttgtctcatacactcaatattctcaagatataccttccaaagtgaaaaattatggcactttgcagccctgtccactaactgagaactttgatgctttggattttggagacctcattttatcacctggtccttttacttcatgacttgtcatgctgccaccttttgatgggattgagatcaagataataattcccaactggtcaggaatattgtgcccctttgtttttatatccagatgcaatagagcctctgacacaccactactattgttcttaggatttggaacaaaatgcttctttctttgacaaaataaatgttttctttaaagaactcttgattgatcctggaccattgtagaaactgaagtcctatcaatgcaaaaaaatatgacaacatgagctgcttatcatgaaataagtgttttccaattaactatcctgcttcatcagcaggtaggaataatagaatctatacctatgtcttcatgggaagttctctatggccagttgattagtgagggaaaaattgagcctgatttacagaagtcactgtacaacatcacagcaacagccaaaagtagattgcttaggcattataacctacgtgaatgcaattttaaaagaaattcagcctatgtaattggttgtccacgatgtctagaaggagagatattattgatgtatatgtggcagctaataatttgtctagataattagggacttggggccaggcctgatggttcacacctgtaatcccagaacttttggaggacaggacaggtggattgtctgaggtcaggagttcgaaaccagcctggctgacatggtgaaactccgtctctactaaaaatacaaaaattagccagatgtggtggtgtgtgcctgcaatcctagctacttgggaggctgaggcaggagaatctcttgaatccaggaggaagaagttgcagtgaaccaagattgcaccactgcactccagcctgggcaacaaagtgaaactctgtctcaaaaaaaaaaaaaaaaaagaaaagaaaagaaaagataattagggactcagaaagacaaacactgaaggattggtggcaatgagttttggggaaaaaatatgtagatgaaccacagaaaatgagccagagtgtaagaatatttgtgcttaatacaaatgctcaccaaactatcatcaggaaggttatcaaatagatatgaaggtatgaaacaatctctttcaccaggcactacattgcttgctcagaaggctaataaacagcaacattggtggtagcagtagagaatacacataggtttagcaacatgttggactttaccactctcgcttacaaaagcctatttagctgtcaagactattaggtgtccaacacacaagcaacaaagtccaaggctaagcacacaataacatatcctgggtgaataaaccagtcaccttttgtcagacttgttgattttactggagctcctctatgataaaggcaacaaggaattttgtaaatggaatctacctttatccttgaattacatttgctttacctgacatcatttttctctgatcgccactctccatgggtacattgaatgccttatatatactgccataatatcctgttctacatccttctattaaaagaacttgttgtataacaaatgagtagatattcattggactcacctggtccaccatttatcctatcaccaaccaaaattattattattatagaatggtgaatattttattaaagactcaatcacagtgccagctggagacaatggcttataaggttgtactcatgctagacgatgtggtggtgtatcctctgaactagtaactaagtataagcttgtctggtgtctcccatataaaaaatacaacaatctttgatatttgttatgaacgttgaagtgactccttttgtcattacatctaatgatccactccaaatacttgtctcttgtctctgagattctaggtttttgcagaattagtacccaaagggagagtcttagcagtattccattttacaatccatccttcgttagaggatgagagacttctatctagccttttaggttgcctgagacctttaaacaaactgtcaaaaatttaaaatttaaaatgcggctacattgttgcatggggtagtaaatcttgaccttaaaactggtatttgtaagaaaaacagaaagaattcagggatcccctttgatggctcctaattctatacagtcctgtaaatattcctgaagactaaccaggcgtagtggtgcacacctataatcccagctactccagaggctgaggaagagaatcacttgaacctgggaggcagaggttgcaatgagctgagattgtgccacttcactccagcctgggtgacagagcaagactctgtctcaaaaaaaaaaaaaaaaaaagaagaaagaaagaaagaaagaaagaaagaaagaaagaaagaaagaaagaaattaatgaagactgccacaacttggaagcaaccaaggtatccttcaataggtgactgcataagcaaactgtggtatattcctacagtggaatattattcagtgctaaaaggaaaaaactatcaagccacaaaaagatacagaaaaaacaaagacattttgctaagtgaaagaagccagtctgaaaagggtacatactgtgatttcaactatacgacattctggaaaaggacaaactataaagacagtaaaaagatcagtggttatctttgcagacgccaccatcactgtgagccctgtactatcagccatggtcaactccgtcgtcttttttgacatcaccgtcgacggcaagcccttgggccgcatctccatcaaactgtttgcagacaagattctaaagacagcggaaaactttcgtgctctgagcactggagagaaaggatttcgttataagggttcctgctttcacagaattattccagggtttatgtgtcagggtggtgacttcacacgccataatggcactggtgacaagtccatctatggggagaaatttgatgatgagaacctcatccgaaagcatacaggttctggcatcttgtccatggcaaatgctggacccaacacaaatggttcccagtttttcatctgtgctgccaagactgagtggttggatggcaagcatgtggcctttggcaaggtgaaagaacgtgtgaatattgtggaagccatggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatcttggtgctcttgctgcagttccctttgggttccatgttttccttgttcccttccatgcctagctggattgcagagttgagttaagtttatgattatgaaataaaaactaagtaacaacaacaacaacaaaaaagctcagtggttgccaggagtttggggatgggtagggagataaatagttctgaaacaggcgatttttaggggattgaaaatacattggtaataatgtaatgatgggtacatgacattatgcgttttgcaaaactcctagacctgtaccacacaaagagtgaaccctaatgtaaactgggggtgggataaaggtgacagtatgtgagaactctgtactttctgctcgatctttccataaagctaaaactgctcaaaaaataaagtctattattttgttaaatgaaagaaattaacaatgaccatggcacgctcacacaaaaagattatcaaggacatttctctgtcaggaatgaatatttggtcatctcacaaggcaaaaccctgactagcagaggtgttagctgagggcacatggccatagatgccaatagtgacctgctggccacttgcagaaaggagagccttgacatccaaacacattgtttctcttgtattgtcctgtgcatacttatgtatcttaacaactttccttctttcctctccatttatccctctttttaaaacagggcttattgagggtgattaacttaatttttaaatgatatatggcagaatgtcaagagagtatagtgaagaacttcgtagaggaatggacataacccagaattcttagacttagagtacatgctgtgattgagaattttttattgtttcattgttcaagagattgtaggtacatgttcaattattagagaaatagttgcactctgttagaaggaagcttgggtctttcgtgtttactttcaaaagggaaagtttatattgatattgagcaagttaaagcatgaaaatttattatttgatgtttgttgctgtgtttgaggaattcctcagcctctcagttttgacgaaaacaagaaaccacctcctgctttagaagctaaaatgccaaatgcttgctttctcagcctcctttgcagctagggtacaagcatatgacttaggttttgcccatctgtttgccagtgctgaatttccacttcggaattaataaaaaaagaagcagattcagttatgctttctcttgtttctggtggaggccatgtagcagctgctacaatatctgttgcaaagcgaacaagtgggagtggtgctggtggctttgcagttagcctaggattgagcaattgctgcaattgttgctgcctgcatcttcggtgttatttcttactggtggtgacagtggtttcctccctggatgagttctacagcatggtttggggtacatttcctggctgcctagctttgatctggctttctagccttctcaacagttctacaagttccccactatttctgtgataaacctatttattgttaatgtcagccataattggcttctgtggtttatattttttaaaattccaagatataccaacgtaacagatagctcaacaaacatatgtctttttaaattaagatatattctgtgtcacatgaagtacaatggacaaaatgcaacaaattgaattgagcaaaagaccaaatatatattaagcctggctggtcttaaaaatgtaactggatacagccaggcatggtggctcatgcctataatcccagcactttgggatcctgaggtgggcagatcacctgaagtcaggagtttgagaccagcctggccagcatggtgaaaccccatctctactaaaaatgcaaaaattagctgggtgtggtggtatgcccctgtaatcccagctactcgggaggttgaggcaggagaatcacttgaacctgggaggcagaggttgcagtgagcccagatcatgccaatgcactccagctttggcaacagagcgagactttgtttcaaaataaaaaaataaaaataaaaaaataaaaatgtaactggatagacctaaggttcttgaataagcagaaaataatttaggtaaaaaccaaataataaactaacattctgaaaggtttaggatttggaggcacaaatgtcttagctaaagtgttcattctaacctcacaggaaaattgaaatatgaaaatatacagaaaaatcttaggcagtatttgtcaattttaagaaacaactatttacaggtttttcaataggcattacattaaaaacgaaatatgtagttaataaatatgaaaactgtggatataatcaacacatttattttacttcttgaagtgttaacatgtgctgtctcaaatatcaacagtgtacacgtgagaaaaaacattttacatagattttctgcgacagaaaacagcatctcattagacatcccaagttttttcatttggaacacacacccattccccagtatactaggggtattaataatttaaagagtttaattactttttactactagaaaactaattttatgtttggcacaaatttctgaaatgatattctactgcaaagaataatacctatatatggccagaattactttttttctataacattaagataatacttgtcagcctgagcaacaaagtgagacctcatctttacaaaaaataaataaattagatgggtgttttggtgatgaggttctgtagtcccagatactcaagaggctgaggtgggaggatcccttgagcctaggaggtcgcggttgcagtgaactatgattgcaccactgcactccagcctgggtaacagagcaagatcctgtctcaaaaaaaaaaaagataatattggtataattcagggtttttgcctcagtccccatgcttcttcatttgaccttccctgactccctgatgaattttagtttgaatttttgctatagtccagaagttaatttaaaagatcttaaaatttccacctgcctagatattacttatttgttacactttagtccatgatttctattgtcatttacattacctcaaaaatatgacctgctgaatttctgctgtcatgaattgactaacatattttgggcctaatacctttacatttagaatctttttgttttgtattggaaagtattgtaactcctccatttattggtcaaaagcactgcttatttatttccatgcttaatcagagagactttctaatagttatttaatattatttacgttcattcacttgttgactataatgacgttagttgctatgatatttttaggtcattaatataataaaaatatgtcaacttttctcttccaatgtgtctttgggttattaatttttaactcagatatcaagcttgtaaaatgtttaatggcttataataatgtctaacacatagtatccactgagttctgataactccagtttatcaaattctctttttttataccattctccaaatgcaatgctatttggttttatttttattttttaaaaatgtgctgcctgttttgagtctctaaaagtgtgaaatgctcagtattttccaaatgtatttgaacatggagtgttatatttactaaaaagttaacaagcaagtattcccctaaacgttctagcaaatactactagtacagacaaattatgatgtaacattatagtacattttaatttattaggttaattttggttgcaaacaatcaaaattcaaaatggcttgtataataaagagattttgaacaatagtataggctcaagatagtttaatgcagaagtttaataataacacaaaataaatgcttcttgtcctccctgtttcttcactctaccttaagtgatatagattgaatgtttgtatccccccaaaatttgtatgtttaaatctaatccctagtgtgatgatatttggcagtgggtcttcagggggtgattaggtcatgaggacagagtcctcatgaatgagattagtgcccttataaaagagaccttagagaacttcctagccccttccaccatgtgagggcacagcaaaaagacagctgtctgtgaaccaggaaacaaatcctcattagaccctgaatctgttgacaccttgatcttggacttcctggcctctagaactgtaagaaataaatttatgttgttcataaaccatccaggctgtgatattctggtatagcgacctgaaaggactaagacattaggtctcagttttattctatggcttaaaatatcatgtcatgagtagacaacttccaatcctagtacctcgtgcttcctctgctgcatttggaaagaaggcatttccctcttcaatcatggaatgaaaaagttgtacttcattctgatttgattagcagaaggcacacgttccttcatgcaccaattacagtgaccaagaattgggcatgggactcatgtcacttaaacattgtgaagctgagaaattcattatttggctaggagtgtgtgagagcagggaacactgaatgcttgagacaccaccacgatgtccactacatgtatttccatttcagtaaacatttccattaagataatgctagaacaaaatcagaggagtagatcttagtgtccccaacttttgttgacctaacaaagtgaagttgcttcaactggacacttctgaaccacatttatgcctatatgttcagttcaaatttattataagcaattttcaggtccatatgtttaggatatttcatttgtttggttatgcattatatgtatacatgtttttaacatacatacgcctctacatatattttggaggcctttacacaaaagtgttttccctaaagggagaagagaaaagttgaatgcagaagtagaaaaaaaaattcatttgcacttgtagtatttatatctaaatattttatgttacagatgtattaatatttttataattttaaacactactttaaaacagggagatggtttaccttcaaaaaatttggctctcaactcaaaattatcaaagtatatcctagatgtagtttgcttgtcaggcttctacatgaaaatctaaaatgctcctgcatttcagaatgagcctaacatatgtaattgcactcatccactatgtctacattgccaaccaaatactgacagagagagctagagtgccacagagagctggcagttcctctgtttgcattagcttctacttgcttcttcatctttcctctatgtctgacacatttcatgttactgtttttaaatgttcccttagctacagagctaatgtgcttatatctgtaaggggtctcatgtgaacctctaaataattaaagattcattagctccctggagggccaccatgatttccaaaacaagtcacaatacctaaagatctaattgtacaatttccctcagaaatagccttgagaaagaagtcacatcactcagcaatgagtattataattactcacagcagttttcatggtactatataacatccaatttacagaattaaaggtaatgtaattcgaaagaaaaatagctggttttaaggaatgaatggccatgtcaactattggaagcatctttgaactagagcctctatgttcgggtttcaccaggtttatgtttttaattaatatcctattcagcttgctgtaatttccattgaggttttctagaacaagacaagtcagaaattgatctttaattataagctaagagcaaactgccaaagaactgagagaaattttgaagaaacaggtctatcaggactaaccattttaagataataaagactaatcagacacacacacatatgcacaaaaagagggagagagagaacaaaaatcctatgaaatacattttaaaaaatcaatttttttaagaagaagcatttgatctgccaaagagaagagttagtagtttggagatctgacattgctaatctcagggcaagaaaataacaaaataagacaccaaagaattacctaaactgtggaagatgaagctttcagagttctcacagagaaatgggatactaaagtaccaagtttaagaggtgtaatctattaatgtttaatttatgtcccaaatacttaaaaactatgtttcattgttatacatatttattttattataaagataatgaatgcagtagggttagatttaaataattcattgggtttaaaatgagaaatgaaagtctggctttttacaacctacagtcttatcaccaaagttagctattgttaataatttcttgtccattcgtgtatgtgttatggtttctttcttagaaagaagtatgctatactagtatacatactatttattcatgaaccttgcacttatcatgtaatcatatgtcttagtggtcttttcataatagatgtctctctttcccatgctgtcagtggtgactgcatgaggcattgtacagacgtaccaataattacttactctgtgtcatattgatggttattcagattgttttcactttgcccttgcagacaacactgcaatgaacatccttatgcatatattattccaaatacatcatcgtgatggctgtgtgagagaaatacacattgttgattttcttttttattttttataatttcagcttttgattttagatacagtgggtacatgtgcaggtttgttacatgggtatgttgtatgttgtataatgctgaggtttgctgcatgattgatctgatcactcaggtactaggcatagtagttttttttcaacctttaccccctccctccttctaccctcgagtagtccccagtttctattgttcccatctttgtgtccacgtgtactcaatgtttagctcctgcttataagtgagaatatgtggtatttggttttctattcctgtgttaattcgcttagcataacggcatcgagttgcatccatgttgctgtaaaggacatgattttattcttttttatggctgcaaagtattccatgacatatatgtaccatattttctttatccaatccacagctgatgggcacctaggttgattccatgtcttagcgattgtgaattacactgctgattttaatagaaaccactaatttttatgccaacaaaatcatcaatgtgcacatgctccaaggctgtgtgagcatagccctttttcttgagatgtcaacaacactgggttttatcaaaatataatttttgccaatttattagttaacaaatgctaactcagtgctatttggatttgaactaccactggtgctgagcaactttttacatattcactggcaatttatttatctttctctgttgtttatctttttctgtgtaataattttccctatcttctactcttttaaacattaagttttcactgttttcttaataatttttaagtttaaaaagtgaccttttggctggacgcagtggctcacgcctgtaatcccaacactttgggaggccaaggcgggtggatcacaaggtcaggagatcaagaccatcctgcccaacatggtgaaaccctgtctctgctaaaaatacaaaaattggctggggtggtggcacgtgcctgtaatcccagctactcgggaggctgaggcagaagaatcacttgaaccagggagttggaggttgtaatgagccaagatcacgccactgtgctccagcctggcgacagagcgagactctgtctcaaaaaaaaaagtgaccattttatctgctgcatataattctaatgatatttctcaattcgtttatcttttaacaatgataatatataatgtcttgctatttagaaagatttttaaaagtattttatataaacaaatttttattctttgccattaatacttgcaggtttggaattttcaggacctcctcaaaggccacctacaggaaatgctcttcaaagacatttcactttttccccacttgattatggagcaaagactaacactggcaatgctttgaagtacttgagtcaaatgggtctctcatgtggtcattactatactcactctcaggctccagtgcaaattgtttccttacgccaactactcttgctttcttttaatagacctattcctcctgggctgtctgaaactaacatttcattgtaaataaagtcctgcaaatccttggtatctcaaagaaccctccttccatttagttttaggagaactttcctcctaaaactctattcttctccctggagtccagatccccattccttgcaacaaatgaactcttgatttgagcactgaagggagataattggaagtttgactttgtgttctaggttttccctgccaatatatgcagcgtctttaaaactaattgggctgcggcaggagaactgcttgaacccaggaggaggaggttgcagtgagccgaaattgcaccattgaactccagcctgggcgatagagcaaggatccatctcaaaaaaaaaaaaaaaaaaaaaaaaaaaaccagcaaaaagaaactaattaggttcaagaagttcgaatgaattcaactaagacaagctcttaagcagacatgttggaagttccagaaaagacagtttgggaaaatatttttattaaaaaaaaaaaaaaaaaagactgtcctccacttcctcactctttcttcccacttattttcactccactggtgcagtttggtgtcaactctcctcactctactgaaactgctgcagccgaggttactagttatttaattaacaaaagcaatagattttggttttttaattgcattatactctactattttgtgacatttaaactattgacaatgtctttcttgaaaatgtgtcctttttgtttttttcaaaacacgactttctccttgatgtcctcctttttctctcattatttcacctttacattctctgctgacacctttcaccttaccaaaccttaattaaatgtgtatgcttcccagtctcccattcttggctctcttcccttccctcttattgatcattattgtattctgtgatctcaccaattctcttggctttaacaataaccagatgactccagaaaactattcaaaattccggacctatggagactttgcacccagatacgtaccaacaactcaacctcagttatctctaatattatctcattaagtgccctctaactacagaatgactcctccttctgggtttcctctgcctgaatggcaccaccattcagtggcccacgacaaatgtggacctcatttggaacttctccctttccctcatgtttcattttctcttggctaaagagttattagattcttcatttttagcttttctctagcctatcttcaattttatagtggacagttatgtataccctatatcccaggagagaagggatatcttcttctatgcccctactatgaactagcatatcctttgagtcctttctttgtatgaagcactggggaaatttaatcaacttcataatcacttataattctcacagtaattttatgagataagttctatttattatccctctcttaaggatgaggaaactgtggtttaaagagcttaagtaatttgggcaaatcataaaagaagcagtgaagacagaattcaaatctaggcaacctgaaatctgagcctgagcactttgcctccctaataactatctccctttgagagttgtattacaaagttgacaacatttagcaacccttattcccctccccacccctatctctctccaagaaatctgctgtgaggtagagaatgtgttgattttctctgcagattttagtgcatagcatagggcttagaaaggagaaaatgatgaaaaatatttattaaaataattgtttttctttgatagttgttataaccatctaattgtgagtgcttaacaattactataaaggagaatggaaatcactgatcttttcacagaatttttttttttttttttgagacagagtccagcttgtcacccaggctggagtgcagtggtgcgatctcagctcactgcaacctccacctcctgggtttaatcacttgccttggcctcctgagtagctgagattacaggcgtgcaccaccatgcctggctaatttttgtatttttggtagagatggggtttcaccacattggccaggctggtctcaaactcctgacctccagtgatccacccatctcagactcccaaagagctgggattataggcttgaaccaccatgctgggcctttctcagagaatttacagtttacctggaaatgtaaactatatatacttaaactgagggatatttacaaaagagctttctacttaacccacaagaagctgtattaataacaaagcaaatcaagcttgttcacaggcaactgaatggaatgaatggttttgattggtcttgccagttatatttctaacaagagaaaattcaatgtgagcctcatttggaaacaagatattacagaaaggaaaatttgggattaaggtcagatttggtgcaactatgctagatacagaaaaggcaaactttcagctcaatccccagctaagtacaagttcaatggtgaaggcataagaaaatgagccattataataagtctgaaataagtttatgattccacctcaatatgggcatgcaatatattctaatatttaatccctggaaaaaatgatgacatcacactgaaatcttgactcataagagaacttttttatgctgttccctaagtcagtttatttctacttcattcttgtgttaagggcaggctcaattcttactcattcaaaaacagtatcacctgaagcttttctttaattcttgttttctctgcagtgacaaaattaatcaaggggttaaaatgtatattaaattatatatgtattatatataaaagttatatagtatagatcagagaagaatatattgcatatgttataggctgaattgtggcctttccccaaattaatatgctgtaccctgccccctgccccctgccatcccagtatatcagaaggtggctatatttggagatagagacttttaagaggtaactaatgtaaaatgaggtcatatgtctgggtcctaatccaatatcactggtgtccttatttgaagaggaaatttaggtacagacaaacatgtgcacagaaaaaagtccatgagaagacaagatgagaaaatgactatctaaaaggcaaggagagaaatttcagaataaaattaacacatctgatgccttgacctcacacttctagcctccagaactgtgagaaaataaatttctcttgtttaactcatccagtctgcagtaattgttataacaaccctagcaaagtaatataggaagtatatatatatacacatatatatatacacacatacatatatatatacacatatttgtgtgtgtgtgtgtgtgtatatatatatatgatagagtagatagatagagacatatacagtcatccctcagtattagtggggtattggattcaggagccctgcatataccgaagtctgcacatactcaggtcctacagtcaaccttgcagagctcgcatatgaaaagttggccctccacatatgtgggtttcacttcccacaaatactgtattttcaatctgtatttggctgaaaaaatccacctataagtggactcacacagtttaaaccagtgttattcaaaggtcaactgttgatatatagatatataaatatctcatatgtatagagcaagcaggagaaaaaatctctaatctctcttccttcctgctctttttggattgcaaactcttctctcataagtacaaaaagtaatgttaacaaaggaaagagaattggaaatagtagtgtttttgaccactagtgttttgtaattttagaaaaaaaaattactgaaatgtaactttttatttatattgagatgttttgactcatactccaatcatacagaaataatagataaaatatgaaaaagacttctttttacatacatagctggattaaaatatcagagataattttcttccctcaaaggatcccctatttaataaatggtgctgggaaaactggctagccatatgtagaaagctgaaactggatcccttccttacaccatacacaaaaatcaactcaagatggattaaagacttaaatgtaagacctaacaccataaaaaaccctagaagaaaacctaggcaataccattcaagacataggcatgggcaaagacttcatgactagaacaccaaaagcaatggcaacaaaagctaaaatagacaaatgcgatctaattaaactaaagagcttctgcacagcaaaagaaactctcatcagagtgaacaggcaatctaaaaaataggagaaaagttttgcaatatacccgtctaacaaagggctaatatccagaatctacagagaacttcaacaaatttacaagaaaaaaacaaccccatcaaaaagtgggcaaataatatgaacagacacttctcaaaagaagacatttatgcagccaacagacacataaaaaatgctcatcatcgctggtcatcagagaaatacaaatcaaaaccacaatgagataccatcgcatgccagttagaatgatgatcattaaaaagtcaggaaacaacagatactggagaggacgtggagaaataggaatgcttttacactgctggtgggagcgtaaattagttcaaccattgtggaaagcagtgtggtgattcctcaaggatctagaactagaaataccatttgacccagcgatcccattacagggtatatacccgaaggattataaatcatgctactataaagatgtatacatgcacacatatgttaattgtggtgctattcacaatagcaaagaattggaaccaacccaaatgtccatcaatgatagactggattaaaaaaatgtggcacatatgtgccatggaatactatgaagccataaaaaaggataagttcacttcctttgcaaggacatggatgaagctggaaaccatcattctcagcaaactatcacaaggacagaaaaccaaacactgcatgttctcactcacagatgggagttgaacaatgagaatgcatggacacagagtggggaacatcacacactggggcttgtcagggggtggggggctgggggacagatagcattaggagaaatacctaatgtaaatgacaagttgatgggtacagcaaaccaacatggcacatgtatacctatgtaacaaacctgcatgtggtgcacacgtaacctagaacttaagattaaaaaaaaaatttcttccctcacgaggtacaaagccaagcattacactggggccatgatagtccaggttgctgaaagatttagaactaaagactgaaaattgggatatatattgagagagagagagagagaacaaatggtaacctaaatttaataaaataataatagacaaattagggtaacaggcatatgagtattttttgttctaacaattcttttattttcaaacttatctataatcttacatttatttcccaataaaaaggattttaagtttaaaaaagaaagtttttctgtagtaacattttcacaactagggcctttaagactgaggaaatactccaagctctgagcaaactcagtaagtataaatccatatgtagacataccacagtaaaatgcaagatactaaagactaatacaatattttcaaatcaaccagagatggaaggcagattacctacaaaggaaggacaattactttatcacagacttctcttcatcaacgagaacagacaatacaggaataacatctcccaagttgtgagggagaataacagatgacatgaaattctacaaccaaataaagcataattcaatgggcagcagttaacagaattaagctgtttccagacatctatggagatatttaactcaaagatgtcactgtaaatttgattgttgagatgtagtaatggatacttggtaaggttattgaattagttaaacgatcttcaaagcttaggtcatgtatcttccttaaacacatggtgctttgcatttactaaagaagggcttctgttttctctccaaataaatcattgcgaccttagcaccccaagtgtaaaaacctcttttatttctattcttgatctctagtccctgcttatgtgtatgcataaatgcatgacaccgtgcttctcttttagttatttatttctagagatcatgtctttgaaaatcattatattcccagcaactatttagagtggtactaagctaacttggtttatagtgtcaaccgcatagcagttatttgattggcccattcctttataaaatattttatgcttagatgatgaactctacataaattcagccaggagaatgttttccttggcaatctctgggagattacaaatgttacttttttttttttttttttgagatggagtctcgctctgtctcccaggctggagtccagtggcgcgatcttggctcactgcaagctccacctcctgggttcacgccattctcttgcctcagcctcccgagtagctgggactacaggtgcccgccaccatgcccagctaatttttttgtattttagtagagacagagtttcaccgtgttagccaggatggtctcaatctcctgacctcatgatccgcaagcctcggcctcccaaagtgttgggattacaggcttgagccaccgtgcccggcctacaaatgttactattaactcctccttctgctaagaaataaaccaaaataaaattattcacaaatataactgttttgatcatgctttcagatgatatgtaaggtagcccacagaaggtaaataatattcaggggaaataaattattacttaagagtgggtgctgagaaaaagaaatgtgtgaagtgtgaggtaggaagtatgtgagaaaagctagggcacagttgtgtcttatatttttgttaaaatctgcctgttaagacttcctgattgggtaatgggaatgatacagtaaaatactcttcctcagagtgtctgacaccattgtgataacttactacataaaagtacaagttatattatataaaaagacagaatggcctggctcagtggctcatgcctataatcccagcactttgggaggctgaggcaggtggatcatctgagatcaggagttcgggaccagcctggccaaaaggatgaaaccctgtctctactaaaaatacaaaaaattagccaggcatggtggcaggcacctgtaatcccagctactcaaggggcagaggcaggagaatcgcttcaacctgggagacggaggttgcagtgaactgagatcgtgccactgcactccagcctgggcaacaagagcagaaactccgtcccaaaaaaaaaaaatgactccaagaaactgaggtttctagatgagggttacacaatgtggatctaaaagcaacagggaaaggaaaaggatttgggcctagaatgtggggaaattttagatgctgcagaaagccttctggtgtctttctagaatggctggattttggttaagacaaagaagaagtaacttttcatggagaacagtagcatacaggagtgcggatggtttgatcatttaaggcagggatgtgaggtttgatggaatatgttgataacaaagattctttgcttggccaactttagtcaggcttctaaatcttcagctaggctaaactgtgcacttcctcacaaaatccagcattagcaaagaacactgccaagtttaccaaataacccctcattctcaatatctgatcaggttcttcattcttcaccattctgtaggtgatgtctgatcaccctggccagtcttcagcaagaattcttttagggcagtttagccagaatctcccttactcctgatgtttcctcttagtgattctccattcactgacccctgcattgctcctgggctataaattcccacttccccttgctgtattcagagttaagcccatctctctccccagctccaagactgtgttgcagtggttcctatatctatggcaatggtcctgaataaagtcttctttactgtgcatttgaagtatcactgaataattttttctttaacaattatggtgttgaaacagattcatcactggatcctgggcctctcactcaggaccctaaatgcatgcctttgaagtctttgttgtcatttctgactgattagggatccattggtgaatcagattcctgagccattgctccagacaaaagcccgttgatggctatggacagattttgaatcttaagggatgaatattctctctgaagctggggtagagtcccaggcttcttttgaaaggaatcctctgggcaggaaggtcttcctgtgggcttcttgttctgagtgatctattctctgagtccctagactagaagtctcttccttctggctctctttttctgagtgaggggttattccctgattccctgagctacaaattgttcttcctggctctctataaaaccactctgctctttctcttctctctattggatcctgcttctcccatgggagctctgtcacctgaaacccctcttctcaagtctctgctgactatttctctgtccactcttgccagacccgtttcttttctgctgaacttcaggacccctatcctaccctcctttgagggggctctcaagggactcagaggcccctcaaaaacaagcacctggggctgataataggagaaaaaaagaaactatttggaaactgataaagtaaaaaaaaaaaaaatcttaaaaaacctcctccacaaatattggtaaaaagatttagcctttgttatgtaggtcaactcaacttatccctttctcaccagaaacacaatttggataacaatataaagtggagataaaccagtgagtttgtatttttgtattactctgttttactgcctcatggttaaaaacttttttttttttttttttgagacagagtctcacttcattgctcaggctggagtgcagcggggcaatctcggctcactgcaacctccacctcctgggttcaagtgcttcttgtgcctcagccgggcgccacgatgccccacgcccagctaatttttgtatttttagtagagacggggttatgccatgttggccaggctggtctcgaactcctgacctcaggtgatccacccgcctcagcctcccaaagtgctgggattacaggcatgagccactgcacctggcctggttaaaattttttaaatgaaaagtcataagatctggttacatcagtctatatgtttgtgtatgtgtacatgtgtgtatctatgttattatgttatgtatatgtgatatttttctacctccaacgttattaccaaactaaaatacccaaattggctagggataaatgagcactcaaacaaataagaatgtataaaattttcagaaaagtagaaactgacccaattttttttaggttcacataatctgggatattccttagtaaataaaaactagtttaaaaaatattggtaaaataaaaatagaaacattttcagaactgtcagcatacacttattttacctggctttgctgattagacaagtttgtgttgttactgttagatgtttaaggccataaaaccataaattcaacctaagaataggatatgtagtaaaagtaaattgcttaattgtctggtgtatgtctgttgcaaatgtaaataagaaaacatatctagaaggattgtgaaaatcttatcttgtatggtctaagctgactgagattggatagatttatttataaggttttattaaaacttagttttagtaatacattgattcaaaagtagaatttgatcttctccgttaaaatggtaaagttttcttggaatgttggtctgagaatgtaaagggtatttttttccttttaagtaattggcctcagaaacagagactgtttcatcaagataatttcttgagtttcatgttgttttattaggttttggttacttaagaaaagtgagtcttctcaatattaaaggagctaagttcttgttcacaactatgtaatctgaatttgcctttaaaatcttttaatggagcttttattaaatagataactatggtcatatttgttttaaatgttttaaactttttgacatttttgacaatcttcccaaaatcacattctaagttaagtctttttgacctcaaattaacttaggattctccatattggaccctcagaaagccacaaagaatatttttttttgtatgaaagagagattaaaccaattagatttatttaatgtgctaaattatatgtgtagcattcaaataaaaagtgatgctaagccatctttaagttatatttatggatatattattgggataagtgtacaaaagttgtatgagattcctagaaatctagtatgttaacagtcataattttggttattatgttaaaatgctgtatgccatgctaaccaaattttcttataaattgcatcattgtaatgaactctcattagattttttaaccatggacattttaagtccttgtcatctgtagacagtcattgttttaatttacttgttctctaaaagcatttgaaattagctacagtccaaaatggcttcttcttcaaggagatttatggaaaatactcttatgagtattctggaatacaggtttctgaacaactttaacatcatacaattggactggtaagaatttccagaactctaataaaactgacgggttcatgtaactactaacccaagatcaagcaaaacaagatttaattacgtggtactgaatgaaatgatgagaataatttttaaaatgactttttgttggaaacattgctagttctttaaatgttttgttttccagatttcagaaaacttttttttaagctatctctagcttacaccaattcagtaaagaatacttttttgcaaaatggaaacatttactttttctccctaacttatccctccagaatttggaaactatttgtgcatattcttatttttatggcaaagtatttatttgcataagtttaataagaatctgttgtctttgtgacaggacaaactggaaacacaggttatatcaccaaggctttgactgaaacatcatgttttcagatatgaccagaaggctttaggggactaaggttggctttatggaaccaataaagtaccatcttggaaaaactggctctagggttcccagacttacaggtaaataaagaatgtcactgtttggcaggtctggaaaccttgggatattttagggacctcaagaagagagaaatttatctgaatctataaatgtaacaggtgcagactaatgacaagttttgggcttgtatcccagcctcaagtggcttttaaaagtttaatctgactggagacagtggctcacgcctgtaatcccagcactttgggaggccaagtcaggtggatgacgaggtcaggagttcaagaccagcctgaccaatatggtgaaagccctgtctctactaaaaatacaaaaaatgagccaggcatagtggcacgcacctataatcccagctactcgggaggctgagcagaagaatcgcttgaacccaggaggcggaggttgcagtgagccaagatcgcaccactgcactccagcctgagtgacagagggagactctgtctaaaaaaacaaaaacaaaaagttatctgagatttcttatctgacaaacgcaacctttaaaagagcctaaatggtcaatcactactcttaactgcacttgtgtacataaccagtacaagtttaatgagattaaacttatttagcaaacaaatcaatctgactttgattatctttgacagaaatgagagtgaatatagagagaaaagttatgtttcgggagaaaactgcagtgcacccaatattagattctagctgttttttttttttttttcctgaggttttattatctgcctgcaatctgcaatagatcctcaatttttctagtttactacaatatttagctacaatactccaaattaatatttcatttttttcctgctattctggcttggaatcactaaaattataaacttttcttttcttgaagtccttcaaactgaaactggatgacttgacataagcttcagaaaaattaccacaacagcttgtgtgtggcccatctttatggcattcaaactgcaaactaatccaatgcctcttctcactccagctgaagatattaaaagcccagcatctagaaatcttattgatcagctgccctctgggctcagaaactgtctttatagttcgttccaactattaatcttttttaattttatttttatagaaactaaacttcccacattaaaggcctgatagctcacactatccaggaaatatcctctgctaccaagtcccaacagatgattcaactggtccttaatgaataaaaggtgatcaaacaagaaaagagacttatactgtttgaaggaaagatgaatgtctcttctttccttaaacaagaagtagtactaacaaagattccttgcttggccaaactttagtcagatgtctatcttccttgcaaaatccaacttttttttttttatgtcgtacaatgtgatgttttgttctttttaaaatttattattattatactttaagttttagggtacatgtgcacattgtgcaggttagttacatatgtatacatgtgccatgctggtgcgctgcacccactaactcgtcatctagcattaggtatatctcccagtgatatccttcccccctccccccaacccacaacagtccccagagtgtgatgttccccttcctgtgtccatgtgttctcattgttcaattcccacctataagtgagaatatgcggtgtttggttttttgttcttgcgatagtttactgagaatgatgatttccagtttcatctatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttgggtacctacccagtaatgggatggctgggtcaaatggtatttctagttctagatagaatgtttcctcttataactcatagtgaatatgactggacaatgaaactattttgtaatttctttcctgaaagataaaggcgttagaacatagaatctttcattgattctacagaatcttaagactccttcagagatggcagtcattcgtaccgtgctgaacatcatgttgtcacggtcagaatcagaactaaattgattaagggtctgaaacagtttggcactcttgggcacttattctgataagaaagctgatgagacagggtaatgaaaagaggctgcaagaaatgaccattcatgcattcagccaacatttaggccaccctcctgtattccaggcactgtacgtggcactgagaatgcaaagcaaaacgagtcatggtctactggcgggagccttctcagcggagaaaagaccaataagaaaagtgtctgctggagacctctcctagggcataaaccaatatagaggtggggcagctacgtcaccctgaggtgtccttaggcagaacagaaagtgagaatcagagcagtgtctcatttctgaacacctggattgtagctttccctggactgactgtcaaaggaggtggttttaaaaagcaagccaaacaggtttccatcctttaggaagaccctggaatgtgccagttgattctgacaatttctcatgaacagaaacacctaggaagggagaactggtgagtcttttcaagaggaggaagtccctcaaaaggggctgtgtttcgcaaacagcgccccaaaagggctgaaatacttcgatctggaggaaaaagactcaggcactgagggaaggggagggtgcacatctggagtaatttcaaggctttttccgtgttatctgaggtggcaacaagtaaagatttgttcgttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgacgcctgcctgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggtcccccacggcggttggtccgggcgggggaaggagaaagtgagactcggtttcatcaccaatccatcgccagaaggggaggaaattggaatccagcagcggcgagcagcagctgggcggtcacatctggaaatggaaagccgacctccccctcctcctccacctcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcaggtgagttcttgcttttccagaacctcggacccagcgcccccttcccagttctctgaccgcgacgtgtgtggctgggggtggggtggagggtttgcacgtccgcattccggggttcatttggcaacagctgctgcaacgaacgcgggagccaaaagcgggagggggcgccagcctcgccccttcccctccccccacccccaagtctggggcagctaccagctttgagggcagaacccgcgtggcccgagcgggggtctaggcgaaggggcagtgcgtggtatttccagccccacgtagtgcccaaagcctgcaagcacgcctcctgggttccagcagcggcggcagagcggggttggttggacccaccaggtttgcgtaatgggctgagcggcggcggccgggaatggagcctgctgcgctgcgctcgtaagctgcgcccggcgccgaggacccccggggggcagcgctcggcccatctccggccccttcggctccatctagtcccctccgactggcaaagagaagggattcctcggattcccaaggcacccagcgcccctgcctggggggtcgcctttcgtccattttgctcccccaggagagagatcggattttgctttcgctgccgcgagccgggctggggctgcttccggcctccccgaccgggaaattcccgccgttgccatggcacccggcacttgctgccgggggcggcctgccgctgcacccagtcgggggcgcgccgcatcccctgggacgctgcgcggagagacctcgccgccctctagccctcccctcccgcccggccaggcctcccctgactccaccaaatggagggcccaagtcctgatcggggttaaaacaaatccactccaggggtagcttttgacaggactttctgtttcagatttcagatactcagactccacctttacttttacctatgttggcggccccagaaggtatttatgggtgtagagttgcttcatttcctgttcacactcttgtgtttcctttgttcttagcgtgttccgtgttcgggtattttggttgcttgtttgattactgtggcttttctttacctacaacccaagcctgacgtccctcggttttaaatagcagggggaggggaatcaatgtttgattcaggtgtttcgaagaccacgccacaggcgatgagcagaactcttcatgttgaaacggttctgctacagtactagattgctctcaggcgatttggggttgatacaggcaagccggtgcaaaactggaatactggatatgaagtgaaatgtataaaagacataaaatgtcacaaaatagtttgatcacaagtgttaattttcctggtgagttggggctgcgtatttccatgttttctgaaggttcacataaacatgcagcctgccaattctctgtatatattttttttcaatgagtggtatttcggttttcacgtttagttgtaagacagaaattggagacttatatgtagctggagtggatgacttctttcttttgggggaagaatgagagatgcacatttcgttagtaaattgtgaacaacttgaaacaaacccaaatccaattgtgaatttaagaagtagagttaaaatgaaaggtagccattcaaatactatgccttgctgccttcacttattaagttaggattttcttccttttagccctttagggatacagtagtttaaaagagcagtagccacatatgaaaggatcagatttagcttagagggaattccttagaccagccctgctgttaagacttgacattcaatattgtttgatcacattccaaaatataccttagctaatggcaacatttgtaaacatataaattgcaaaagaagctttcttgtgtacatacatttttaaaagcttgaaattgatgtgaacttttaaaaacacgtaggatctgtattacattctatatctcaaaacaaatttaattaaagtgaatatcattccagtatatacaatatgcctaagacccagaattggcacactgatttactagttgaaaatataacagtattcaccaaacttcaatgtatactttttggagagaatgaaattacagtatttcttaatttactgtaatgtcatctttgtaattatgaattaacaattcaatgagaggagacttggttgattaaattaatgctggtcctacacattatatctaaaggatcttcgtatatgactactatcttcttggattattttaacagttaaaatatacaaagtggcccattaaaaacagagttgacttttcaccattgctgtttttctggtgagacatgtggaaaggaaggacaggtggacttttcaactaactagctctctgatttttaataagatacctcagttcttttggcctcagtttacttatctgtacaaagggtaagtcatatgcttaatcactaagatctgttagatactgcagttaagattctttatcaacaaattactgaactctagtgttaacatagctagaggtggaaaagggagcaagaccaggtgttgggatgaataattaactaatcgagataacatcagttttcaccataggaacaagtaccatggttgctcttaaagtaagagatgtttcctattttatgtaattttactaagggataatgttttcttttgtcactgatttaaatgtacctggatgtttctcagccatgtggctaagatcgaacacaagtaatacctgggccttttatatctaatctaatgtagaccagcctgttaaaagagaaagacaattggttaaactgctgatgtgttgctttgtcttctcaaaagcttgttctataatacaatatgtaaaaagttgttacagtgtagtaaccgtagataatccctttatgatttgtacctaatgacgaagaccttttattttctgaaaataacatgtttgttttcattaccgacattagaagccaatatttattaatctatttctcatcctgacatttcagtcagactcttaaaataatcttgctgtgttttgatttaatgtgcttatcaacttataatattgaattaatgttaatagtgtcattttaggtgaactagacttcattgaaggaggtgggagccttatggagagagagtatatgattatctctatttgtatttaattaccatttcatctaaccgttcagaacatatttcaagaataattttaattcaagttgtagataaaacttactataccattttcattttgacgctttccgagaatgagatacacggtattttaaagacaaagattgatcttacatgttactattaaaaaaaacacgataattttgttctacatttatacttttaatttttctgtggataataagaaatgccaagagtcgattgtgtccatgctggcaagtggcctaataaattgtccttttatttggtggtcctcagagtggcagttaacatcttgctattctgccttgtggacttgaggtggaaaggttcatggaattatatccttgcttttggatgtgcaaactgaggctcagagagtttaagacacatagtcactttcaccaatcaaatgatgaagctgccatgtaaacgtatttcatcacactcccgagaccttcttctccagtagtgttttcaagctttttgagcatgcagacactaccaatcaaaaaattatgtagagacatacttgagagttacagtttaaagaaaaacaaggtgtaattatttggttattagtaacatttacatatgtttgaaaacttctgctatatatacagtaagattaatttattctaacaatgatcttgataatccccctgattcccagactccttggaatagctccacagctatcagtggttctgccacaggttcagagccttcccagtactgccttcttatttgagaggtgtgctaagagctataaagcagaggcttcaattgtacacaattgggaagtttaggcaaaagtcatttcttccctatattttgtcatgcttatctcctgtctctttctgttttacagattagcaataaactccttaaaacccaaaggtttgggcttctgttcctttcacttgcagtcagacatggagttagtggtagaagaaacagaaggggtaacctgcatggtgacagctactgaggggatggataggaaagcaggctgagtccctggggccagtggttaccaaagccaaggagagagcaaggggagcccagtgggcctggccatggactgctctggaattccgagtgtgaactttcagccaagaaggtagtgtgaaaatattactgtgaggttttaaaagtaca

SEQ ID NO: 311 - DNA, 536223 bp, Homo sapiens
  misc_feature (414834)..(464833): n is a, c, g, or t
gaaaggcctatgatttcaaagggtctatgaaagtatcagcctatgaaatgaaagtcctacctgcctctgtggaatagtattcaatgattctttagacaggagtgatgacattttgcagctctttgagtcatgttggatgggatccaaataaatacttgctttacataggcccttccccagcctcagcaaagagttcttcattctggaggaattagggccatcatatccagcttgacttcatgtcccctttctcttctgaaaaactccaaggtggaactgacatattgaccggttagtttcaggggaaggcaagtacatgtagacaaacaaacattcatgttcacaggtaagctcaatcctgtatgccgctgcactcacaacttgtaactgtgggagtgaatcctacttttagaactttccttggagtctgtcatgaaggattgtagtaggagccaggagcagggccactggacttttccattgtgtatactgatgactttaagatactttattctctacctcttgtgtctcctgctaggaaatacaaagggtgagaattacaacctctaggttacaagccttagtctaattggtataccacagtgaactgtgatctctgacattccacaggtctccttttagtctctattcttagtaatcacacacttccttgaaaatccttcccttctgacaccgcatttgcttcttactcatgtttctttctgcccaggtgccagcactattcctcctgcttccacagctacattgctgagcaaagacttggaagctggctcttcccactacctcaactctgcccagcctgactctcctccaagaggcaccatagaactgggaagaatcctggagcctgggtaccagggcagcagtggccagtgggacatgatgagtcctcagaaagggagtgtatccggggacctatcctcaggctcctctgtgtaccagcttaactccaaacccagaggtaaagcacaaagtggagatggcagcctttgaaaagaagtctcattcagagtctattcttttcctacccaggcaggactgtttcattcctcctccatccctggctcacagagtggggggtataaaatgaaagacctgtatcagggctcaatcctttccaagtacgttcttcattctcctgcccagggcctcagagctctgtagggatatgggaaagtcggggacccacctcttgtgctctcatactcatgtccttccatctctctgcagcctggactctttgcagcccagcctctttgcagcccactctcttagacccctctagaatgccaggcatagatgggactttcttccatcagtcaggagttgtcacaggaaagggtgcaagggtgcagctccccaaccctgcacatatatcctgtgaacaaaattcagtcacagcaagtggagaggtatagctaagctcataaatgctgggatgctactcagttccaacagtaagacaatcgtaattttcaggaaaagactgagcccaaagcaaaatggttcagttaatatccgacgtgagcatccctctgacttttctgcatctttttcctttgtttggctgggggaggggggtggtgtcatcccctctctaatctgccctcagatctctagatccttccaggctattctttcatcttccatattaaaagtgatttcagggaagcattcagtgtcagtcattaactgcatagggtgagtgtaagatcacatacttttactttaggccttctttctaagggtgggaggaagggctttgtcccttgctaaagaatgctcactcatgtgtcagtaagaagaaaggtagagtgaggtctcacctatcatcctcatagtcacacccaggaggtggccatacctttccagatgctaggcaggccttgtccagagccctcagttatttttctaaaacatgtggaactctcacaagacccctgtgtgggaggaggcccatggagatgttttagcaagtgactgttatgtgtttgaaagcacattgactgtttaaacaaactaccattcctttgggtgtccgtgtgacagcacacagttggcagaagactagtgatatttacaggtcttgctgcaaggcccctggctaggccccacacccaccagtaaccaggattctccatctcccacctctctccatgtcctgttggtttggctacagggactgccctggtggaagagcatcttggtgaaatccagaacttgcgccagcacctagaggaatccatctgcatcagtgaccacctacgggagcaactggaacaccagctgggctctactgcccatggaagtggtaggagaggccaagaccttcctgtttctggctctatttagggacctttaggcagagcttcacagatattctttacttcacttgctccttataaatagtccaacaagggaggtgggcaagtactgttatccctactttctgaatatatctgagtttagagagtaactctctttaaggcagaactagatctggtccccagaatcacctgacatctcaccccatacttaatctgcttatatactgcctgctgatgtatgtgcctttgttgcgtgattgataagtggtggagccaggtctgtaagggtcctcccaactccacccctggccactttaccaaggtggcctttctccttacactctccttccaagctactgtcacatggaggccagtctttccatatgtttttatcttgcctataccatagcagcagctgtttagggagactgagactcttgcaccattgcagttacggcatgtgatgatgcacgcaaagaatccactgagaagaggcacacagaaaacatgtacccagacccccatgcttcattcagggccaggccttgagtccttggggttttctgctgggttggggcagtatctttgagagataaagaatgggaaacttttggaagcttctgttacccaaaagtatactttctgggacaggatccacttctaacttctacagtcagggcctggagtccatacctcagctctgcaatgagagcagagtcctcagggaagaaaattgaagacttcaggctcagctgagtcatatttccaaaggtacatggtcaaaacccacaaactgtggtcactcttaagtttcgttcttccctggccacactaatcaccaactggagaagcaaatagaagaaggtagagataacagagctactcagatccaccaacccaaactcacagctattctcagtctagagaaggctgctttctaagatgtgccaactatgggcccctcagactcctagtccccaggagtgaagagctctaggaaatccatcatttctgtacaacccacctgcatatatccagagtcaccagctatcaatctggataccagtctggtatctgttctacctcccttcactcacaactgatttggaaccaataaaggagggagtgcaaatgcctatcttccctctcaactttctccagactttattgcagcagcatgtgttgctcctggccctgctctgccatacctctgcctcctcaccacatccctcactcatagactcagggctcctctctggccagtactcctatgactccatgccaagtggcaccagcaaatgccccccagcactttcccagccttagccagggggcactcacaggtgggcatcatttctcgtgtggctgggagacagctgaccttggtgttcgtctacttgatcaaatcaatgtattatcgataacaaagtatttttattcacaaatatttattgaactgccataaaaagactgagagtagtatccaaaaggattaagcccagaatgaaggaatgcttgtggaaaaggaaaacgccaccaagagatatttctaaattagccacctaaattaattaattaatttaattaattgatttctatattagcaagaaaatttgagaggaaatgtcactgctgggggacgataacaaaagttaacagataagaaagagggcagaactactaagctaccattgcatgcttggagagaatagaagagacctcacaggtgagaagacagtaagagatttaaatgaatacagtttgtcaggctcaggtgaatccttccccagaggacttactgagcccgcagctgtatttttagagtgtcttcaataatctttgacaacttgtgaagatcagagaagtgctgcaagttcaaaaaagaacaaatatcccagttttcaaaataatgaaagtgatatattccaaaaagaaatcttgatgttgatctttgtcaaaattcaagaatggattattgaacagatggtatgtgagcacttggaaaatggtgaacattagaaaccagaatttctctaaaagcaaggtaggacagattaagtgggacgaaaggttttgcagagagagagatgcaccattctccaggctgcggtggatgttgagccagcatgctcttccccaccaacatagggccttccttccctgctccttagctgtttgtcagggcagatgtgcttggggtcatcttcctgctgagctctgaccccatgataataaatcaatcctccgtgttcctctcaccagagcactcccaggaaatggaaagcctgagggaggctctgctgtcctctcaatcccaccttcaagagctggaaaaggagctggagcaccagaagatggaaaggcagcaacttttggaagacttgagggagaagcagcaagagttcttgcatttcagggaggatcgtctttccctccaggaaaatgactccaggtaagaggggacccattgacacagaaggtagcattcttcattcttacattcattcttacattagaagaagggatattggcaagacaattggtgtcctcttttggaaacctcaacgttccctctgctattcctgatttttgtgtgtcagttgttggataggaaggcgctttgagcagaagaaagtacttctctgggaatgccttgtcactcccaagttgagagagtaaaactctgttatagaaatcttcagtatatcagagacatgacaaggaagggttcccatgcttccaattaggtataggacattagtctcaccatcgcctaggaagcttctatactggctgtgatgctaggtcccatcataagccctgtaactgcttgtcagaatgaaaagagcactgtaggagcagtaaggagactgtgctggtgtatctgttctgctctgaactaatgtaggtaatggtgtgttttcaagcaaagttacttgacctccctcagccaccatttccacatctgcaaaataaaagtgatggtcttcatgaccccctgagttgacatctggggctcagatgtaaccctacccataaacctttatgaacccctgggttgacatctggctctcagcttattgctctggtgtgactgagtggccctgccatttcagtgggccttgccgctccctggtcagactgcagcacaagctggtcctcctgcagcaacaatgtgaagagaaacagcagctctttgagtccctccagtcagagctacaaatccacaaggcactttatggcaattccaagaaggggctgaaaggtttgtgttcttctccccttaccccatgaactttttgctcttgcataggatgctagtgaggtctttcctttgggagttgtggagatcatgggaagctacagagttctgtctcagaaaccccacccaagcctggggctcccagtaggaactctcatgcacaaagcccaaggtgacaggttggtagcacgagcaagatccagcctgatcattcttaattactttaagaaaatctggacattcccattctagacattcctatcaatgtctagaatataactttttttttttttttttgagatggagtctcgctctgtcacccaggctggagtgcagtggcatgacctcggctcactgcaagctctgcctcccaggttctggccattctcctgcctcagactcccgagtagctgggactacaggcacctgccaccatgcccagctaatttttttgtatttttagtagagacagggtttcaccatgttagctaggatggtcttgatctcctgatgtcatgatctgcccacctcggcctcccaaagtgctgggattacaggtgtgagccaccgcacctggtgattataacattttttaaagcaaaagaacagtcctaatgatatcatttgaaaaggcctctaatattgtcagtgatacatactgacaacccattcagcccaatgtagcaggcagtctgctcccaccctgaccctttccctagtgacatctggctctcagcttattgccctttcatttaattttcataaatcctgatttagtttcctgattttctaaagagaaggtgaactggaatttgaagaaatacaggggcttaccaggctcggtgaatagcttaagttcaaagtcatggtgagtgttgagtcagtggggaccagcctgcccacaggagaaaattaaaagacatgaaaacaaaaaaacttcatagaaataccactaataagacctaaatttcaatcctggatttaaatattaaggacattttttgaagactttgcttcctactgaaataataatctaatatttgagaattttgatatatttcttcattcttctttaaatggaggagagtactcaaaacataacgttaataagtcacagcaggctgggacagagggctgacatcaatgtcatgaaatttagcaaagattaaaagcaaaatcctgagctcgattaaaagtatcagtggtagaaatataggatgagcatagaaatataggacaggcagccattcatggacttcagggtttggggtttggtagaaacatgttcacacaagaatggcataggcaaaaggatgctagaaataccagctcaaaataacactacagtagtgtaagtgtgatgttcacctgtggagaccatgtctaaaatattgttagattatggggcaccatctttgaaaagggcattgacacactagggaacataatgaagacagggcgcacaatggtgtgtaccagacatcttgaactggtcaaagaaactaaagaaatttaggctttcaaaagatcttgaggacatgagaactggcttcagatatttgaagaactgtcaaggtgaaaaagaactcatgtattttatgtccctccagagggctaaacaaagagtgaagggcagtggaatttagattggaattatcataaatcctgatttagtttcctgattttctaaagagaaggtgaactggaacttgaagaaatacagaggggctcaccaggctgggagaatagcttaagtacaaagtcatggtgagtgttgggtcagagggaccagcctgcccacaggagaagcttggggtttggggagtgagaagtcaggatggtggagcagagtcatcaaatcttgaaagcccacaggtcagggggaaagttgacattctgtacagtagataatgaaactaagtctgttctttttcaaagaagataagtatatgatgaaaacagagctttcagatgctaagtctcaggggatgtcctggagttgggagacgttagaatctgggaaacctattggatgggtctagtgatattctggcacattaagagatgacagtctaatataaggtgctattgggaagatgaaagggtatagatagatttaaaaacatctctttaaaaaataagcaaaatttaatgagaacttggattgagaaagagagagagcaacatcacaaaactttgggcaaaattcaagagtagattatttaccaaagtctctaaaactaattcatcctgagctacctttcctttcatgcttttctccctgccttttaggactcatttcagagctacaaccactaaagctccataatctcttttttttttttttttaattatactttaagttttagggtacatgtgcacattgtacaggttagttacatatgtatacatgtgccatgctggtgcgctgcacccactaactcgtcatctagcattaggtatatctcccaatgctatccctcccccctcccccctccccaccacagtccccagagtgtgatattccccttcctgtgtccatgcgatctcattgttcaattgttcaatttccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccttgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatgatatctcattgtggttttgatttacgtttctctgatggccagtgatgacgagcattttttcatgtgttttttgactgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccgttgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgtttgtttttctcaggtttgtcaaagatcagatagttgtaggtaagcggcattatttctgagggctctgttctgttccattgatctatatctctgttttggtgccagtaccatgctgttttggttactgtagccttgtagtgtagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtctgttgttggtgtataggaatgcttgtgatttttgtacattgattttgtatcctgagactttgctgaagttgcttatcagcttaaggagattttgggctgagacgatggggttttctagatatacaatcatgtcatctgcatacagggacaatttgacttcttcttttcctaattgaatcccctttgtttccttctcctgcctaattgccctggccagaacttccaacactatgttgaataggagtggtgagagagggcatccctgtcttgtgccagttttcagagggaatgcttccagtttttacccattcagtatgatattggctgtggatttgtcatagatagctcttattattttgagatacgtcccatcaatacctaatttattgagagtgtttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatgatggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctgttgattggaatagtttcagaaggaatggtaccagttcctccttgtacctctggtagaattcagctgtgaatccatctggtcctggactctttttggttggtaaactattgattattgccacaatttcagagccttttattggtctattcagagattcgacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgatttttagaagggttttttgtgtctctatttccttcagttctgctctgattttagttatttcttgccttctgctagcttttgaatgtgtttgctcttgcttttctagttcttttaattgtgatggtagggtgtcaattttggatctttcctgctttctcttgtgggcatttagtgctataaatttccctctacacactgctttgaatgcatcccagagattctggtatgttgtgtctttgttctcattggtttcaaagaacatctttatttctgccttcatttcgttaggtacccagtagtcattcaggagcaggttgttcagtttccatgtagttgagcggctttgagtgagattcttaatcctgagttctagtttgattgcactgtggtctgagagatagttggttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttcagcctatgtgtgtctctgcacgtgagaagggtttcttgaatacagcacactgatgggtcttgactctttatccaacttgccagtctgtgtcttttaattggagaatttagtccatttacatttaaagttaatatcgttatgtgtgaatttgatcctgtcattatgatgttagctggtgattttgctcgttagttgatgcagtttcttcctagtctcgatggtctttacattttggcatgattttgcagcggctggtactggttgttcctttccacgtttagcgcttccttcaggagctcttttagggcaggcctggtggtgacaaaatctctcaccatttgcttgtctgtaaagtattttatttctccttcacttatgaagcttagtttggctggatatgaaattctgggttgaaaattcttttctttaagaatgttgaatattggcccccactctcttctggtttgtagggtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttgattccattctccgcatcactttcaggtacaccaatcagacgtagatttggtcttttcacacagtcccttatttcttggaggctttgctcatttctttttattcttttgtctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcgaagttttcaacttctttgcctttggtttgaatgtcctcccatagcttagagtaatttgatcatctgaagccttcttctctcagctcgtcaaaatcattctccatccagctttgttccgttgctggtgaggaactgcgttcctttggaggaggagaggcactctgcgttttagaatttccagtttttctgttctgttttttccccatctttgtggttttatctactttgggtctttgatgatggtgatgtacagatgggttttcggtgtggatgtcctttctgtttgttagttttccttctaacagacaggaccctcagctgcaggtctgttggaattccctgccgtgtgaggtgtcagtgtgcccctgctggggggtgcctcccagttaggctgctcgggggtcaggggtcagggacccacttgagaaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaagcaggcaggcctccttgagctgtgatgggctccacccagttcgagcttccccgctgctttgtttacctaaacaagcctgggcaatggcgggcgcccctcccccagcctcgctgccgccttgcagtttgatctcagactgctgtgctagcagtcagcgagattccgtgggcttaggaccctccaagccaggtgtgggatatagtctcgtggtgcgctgttttttcagccggtctgaaaagcgcaatattcgggtgggagtgacccaattttccaggtgcgtccgtcacccctttctttgactcggaaagggaactccctgaccccttgtgcttcccaggtgaggcaatgcctcgccctgcttcagctcacgcacggtgcgcgcacccactggcctgcgcccactgtctggcactccctagtgagatgaacccggtacctcagatggaaatgcagaaatcacccttcttctgcgtcgctcacgctgtgagctgtagaccggagctgttcctattcggccatcttggctcctctcaagctccataatctcttatctgtaatttcaaaatccagtaagatctccaaattaaatttttcaaatagtcatttagtgacaaaatctagatgaactgacaagaagatattcataagtctttatttatctacttagaatgttcacatagctcattgcagaaatagttatatgtttgattaaggattgtggctcacctgcaactgggtacatgttatatacgatatatgcaccctgttgccttgctaaaaactaaaacaaaatttactttttgagatacatttggccttaaggttttcagataagggattgtggacttgtagaatatttcttagatctcttcatccccagtacaaagaaataaactacatgtggtgaatggaggtaaatatatatacacatatatatttttatatatgcatatatatttatatatacgtgtatatattcatatatacatgtatatatttatatatatatgtgtgtatatgtgtgtacatatatatgtacatatatttcatatatacacatatatagtatgtatatgcacacaacatatatacacactatatataggtgtatatatgtacacacgtacatatatacatatatacatgtatacacatatacatatatactgtatacatatatatacacacacagagagagagagagagagagaagttgaaaaactcacttagttataatccctcgtctaagttgccgaactcatatcctcacatgctaccaaaaggcctcctccttctcctctttcatttttgagagtgaagactgtcaaatctctttctccttcatcccctacccttctctagctcagtgctgaccttctaccttggaggatcctatactttagcctacaggactaaggttactatggagatgaaatatggacttatccttatctgccaatcaaatgctctataggtgcatgtgtgtaacttaaaccacaaagaagtttcagactggatgtgtgccagctcagtgccatccccaggccacacacagaaatgatgacatgtccatcatagatgggttgcatgagactcagatgatagtggggtccttggcagaaaagagtgtcacagaggagggttctgacaagtgcttggaaatacttgggtcaatgttaccagactcctcttctctcttaggttacagcctggatgcttgtcaccaaatccctttgagcagtgtcctgagccacctggtgagagaggtacgaggtctgagagggcagctggagcaaagcattcaggggaacaattgtctgtgactgcagctgcgacagcagctggatagcggtgctggcaaagccagcctcagccccttctccattaacaagaacttcccagccagcactgaccctggaaacaaacagctgctcctccaaggtaggaaggaaaagggacttagaaagctctcagccagtggggagatcaccaggatgtctgcagcagaaggtgcaatctgcctggtctatgctccttagggtcaggttgaaatcagagatgctctagtctagcagcctgagtgaaagtgtgggatttaggccaggccaggctccagattctgagtttaccacttaaagatcatttgatttgggcaaggtgtttaaagtatcagaggtttaggccttagtttccttatatttaggataataataatatataccttatatgattttgagcattacatgaaatcatttacaaatgcttggcacactaagaattgctcaataattagtagctgtatatgttcatatctttttcttggatttgcttagtgctttagtattagcgaagtgttttcacatatagaatttcatctgtagtaaagcaggttttgctgtctctatttcacacaagaaaacttaggtcttgagatattaacagacaagcaagggtttagagaagttatagacaaagccaggatcagaaccagatgttgtgattttcagtctgtgttccttccagctcattgtgttctgtctcagtattgccgaccttcccagattctctagtccccctttccctcacaggtggggaactcagtgtgtggcaaaatgttcctgcccttaaggaaacagggctctggggaagttctggacggtgggcaatttatttcgggtggccatcattcactctctacccctccccttgcctgccttttcagataggcgtgtttgaccaggacccccttctcttctcgatatcccccatcaatctcacttctcccagttttaactgaaatgtcaatggtgtccccctagtcttaaatcattcaatttctacttcctctgtctttttttccttttgatacaccatttagtacaccatctccactcacctccatggccataccttcaattttattcaaatcaggaaccactgtttggtttcgctaaagctgagctttcactctcctgccagctatttctgggtcatgttaatcttcatttttctctggttcttgtagatgcttgtttatctgacagtaaccttatttgtcaaatgaaggtgacaataacatgattacgctgcgttggcaattcagtgaaaaaacacatgtgggccgccatgcaaaccgcctggctgccaggaacttctcagcttacattaggtggatgccttgccctcctctgggctgcgctgatagttgtggtgttcagttatgtctccaactcttccttctaaacaggccttcccctctcactggcttcccatacagcagccaagaagccccactggcacagtccctgcctctctttctctagcactcccgaggcctgagccagaaagcaggcactgggcaacacttgcctgagcaggaccttttctaccttctttgtgatattttcctattcctctaccatagggttgctttttagtctccagcaagacaatgttaacccaccaagacttccatctccgttctttagacacaagtacatttttttcagtattaccctcatcagaatgatggctagaaagttgagtttagtcccccatgaatccttttattatttgattctacattttaatatgtactatgtatatttatacatattacatttagttacagggcatcgtattagataccacacagagattatactcaagacttggtttataaaaatacacctaataatttttcaaactagaggttactttctcatggaacatccctcaattaaaggaatatctttttgttctgaagaatggaaacattctgaactcagtgactcgtgggattttgcttttcttttgcttgtggcgtacgcataattctgtaagaggagagtcctgccaccttaggcctcagtggggatggctaggtgtgcatgtgcttcatgtgcagtgtgttccagggctcctgaaaactgtggttgcctttactccccagattcagctgtgtcccctccagtctgggatgttggtatgaattccccagctctggtcctccccagctctgtttcctctactcctggctcagaaacagccataatcaacagaacaaatgctaaatatggcaactaaagggcccagggactgatgatggaaagtgattaacgcaaacaacctttttttgtctctaaacatattatctgtatttagagagttttctctgcatgccccaaggcctttagccctactcactgcaccttctgtggctggctttcttgccattattcatcctccaatagttttcctattgctgtttttgcttcattgcaccataatctctccattcttgaaaatgttctctgtatccagcttgatttccttgtctgtgtcttctctacccagaaacttattatttattatgatttgtcctatttcattagccaataaggaaaaaattgtctcctggaaaatttatctttaagacataatgtaagaaagattataaaaatatagaagccagaagatctctatggactttgccccagccttgcacattccaaggcttcctttcttgctccaagcctcttccttttcttgttccctgcctcttttgagttggagcaaactgaggatatcattatgaataacagaagattccattgtgttgtcattttctttttcaggcttgggtttggatacttctccagtaatgaagaccgctcccaagctggagagtgatgctactgatggcccctttgccaataagaatggccgccatgtcattggccacattgatgactacagtgccctaagacagcaggttgcagaaggcaagctgctggtcaaaaagatagtgtctcttgtgagatcagcatgcagcttccctggccttgaagcccaaggcacagaggtaatcacacctgtaggtttaggtgcactctttccctgtgccctttcttcctttgatgttaactgcttcacccacaatttttgtttttttctttttttcatgctttgccttcctcttccatgtatagcagccaggccctttcttctctatctcctattttcactctgagttctgctctgttccagatgtagctgactggatatttcccctcagccccacagaaacacgtggcattgcctagcagcctttggtagcttattatctactgcagtcatgcaggcacatgaccatctgtgggcacagtcgactcaatgggatggacagaaactgaaggatttgcaggtatatggcccccatatgtggaaggggtgagaagtctggcagccatggcatttccttgtgcagactgcatagggagagggaaggcaggcagcaaagcttgtcagagcaccttgccagtgagagagaccaggcaccatggctgtgctgtctgagctgctggagacccatgaatgcataggagcagccctgtctccacggaacccccacactagaggacaagacacacacccaagtagataagcacagtaaggggctacaggcacagtatgagaagtcatccctatgctgtgagagcgccgatgcaaatgtggtcatttatctcaggcgaggaaggtaacaggttcatagaggacacagcaagtggggtgagttttgaaagccttgtgggttctgcaggtggagaaaggcatacctggtaaagggagcagcaccttagttctgagtgctgcaaatggttgtgagagggcttcacaggttcaagcaggcccatgttctgtgcctcactcacaaaggaaacttgagcccatgcagggggaagaaagtaatctctccacttctgtggtgttacctttccccaggagcttggcagcaaaggcattcatgagcttcagagcagcaccagtgccctgcaccatgccctagaggagttggcttccctcctcaccatgttctggagagcagccctgccaaggacccacatccctgtgatgcctggcaaagtggaaagatgccagtgtcctttcttggttcaaacccagttctcctgccctctaatactgttctttctcctcaatgtcacagcttttccagaaaatcaggagccacatagtaagttgggatagacagaaacttagaggagtgtccctggagggacatctctggcccatggtggctgctttcattgcagctctaaatacatcccattccctgccagccccctggcccctggataagaaatcaaagaagaataggaaggggtgtggagaaggcagagacatcataaccctggcaatccataaatgttcagtttctttacctctctgaaatttggctgagatgaaattaagtgaaagcttcagcacccatctcccacccctcaggtcccatggtcaaatgatcacagaatgcccccatgagactgagcctttttagccactgcctggaatccctgcatatcacttaagctggcctctctggaccaggcctggggaaagtcagccacccctcaggatctgttcagagctcaggctaactctgattggcagaccctcatgtaggcaggtttcaggatcccctccccagggattctaactccagatcaatgtcaccaataccttttggatccaactatgctaattccagggagacggtgttttgccatcttcatgttggcacaaatatttacaaacttgcaaacttgcctgagtccagatctctctctccagcataacatttctgaactctcaatcttacctgtgaagggagagtgacagaactgatatcaggactaaagcaaggtcctcttcagatttgggagctttataccagcctgaagtgaggttctcttaagctaaaggtgtgtaggcctgtgctagtctgcatggggaattccagagtctcaatactcctgcctaatggcctcatccgaaactgtcctcagctggaagtattcgaggctgtgaaggaggaaatccatttcaggagagtggagaagattgtagaatccttctttgaattggaaagagccacaaagcacagggtgctttaggccttctgcctgttcagtaagagtctgtacctcttatcaagggagaattgacagaaagggaacttctggaactgagaaccaaagtatccaaacaggagtggctccttcaaagcatagctgagcatctgaagaccgccaaccagcagaaggagagcatggagcagttcatcatcagccagcgtaggttccctgagagggaatgggggaagaaacaggcagtcttcccgatgccccacttgtgctgcagatgagcagtgaccaggggggcttggggatgttgggagttgagactgatttgatgtccccaaacctcctgtgccatgagcaattgtggatgcagaggagaggaggatggggtggatagcaggagactccaagctgaatggccagaaagaaataaatgctttagaattctcatgctaagcaagtagggttaatttttgctggtgatttctactctgtggtgctcttttgttgtttcagtaaccagaacacatgatgttttaaagaaggcaagcactaacttagaggtaaggaaactactgcagcagtcagaggcaccaagcctgtccccaacccattgccatccgttagcatatcttgtaggtgacccttggcctgctttggccttccaggagaagattttgggtccacttgcaagatcacaggtcctcagtgagcatcctgctaatttctgttcccatcactctctcaccccgtcagctcctgccccagtattttggttcactctcacattgtcgtcatctctcctttttactccaatttttcttctttgatgccaagtcaggagactggagaaatgcaattcagctcactctcaaagtcattagacatccggaagtctgcctctgaatgagcttttggtagagggatcttgaggccagttatgtggtctagtcttcatgaaaaagtaaaagcaatttgcaacctaataaactgatttcactgcacactcctgtgttaagaacagcaatttgattttgatatatctttaagaaacatgacaaaagagatctgttgggtctcattggtctaaaagagaatttgttaataaataacaactgaatcttaaggggaaaaatgttatatatgtaccacatattctctacatttacttaaaacactaagtgttaaccgttccctaggaagtgctttgaagaaaaacttgaggtatatgaatggtttaaaaatcagaaactaaaccttttaacgtggacttcaaagctttgccataagcaattgagcatattcctagaaatatttctaaactgtaacctgagagaatgttgatctccatagtgtgaaaatagtgtgaaaatgacttgggccagtttaacttgctcttttttttttttttttttttcactaactcccttttgtttttctctgataattcttctctttcctaggcctctttagagcaacacttacaggattgcctctgtaaagccttattcctgtcccaggaaaggtaacccaaaaagtctcttgtatccactaaaaggtaacccaaaagtctctagtatccactggctttctccagtgtggaagctttcccctccacctcccatagatcactggaaaggacccgaggcctcggttctaatccctggcttatcactaactgctgtgtggccttggcttgtcctttaatctctatgagactgctgcacccttatctgtcaaagatggaactggacttagttgagctctgaggtccctgtggacttggcccctccacaccctcattgtggcaactggacataaacttaacagaggacccccctgcaaaatgtcctcttctttctacaacaggctgtttctgtatgtgcatgtttcatgctaagcacttctttcttgggtggacttggcaaagccctctttctgctgagacagtgatttggagagtcacctggcccctgaagagggagtggtaggatccagccacccagtgtgcagtgaatcggagcagggatctcagcacacagggaggtggggaggctccccctaacctcaggcacctgttgttcttcgagactgcagtgcatgctcttagctcatcctcttaactggctctcaccgtgctcctgtctttagtcaccccatagctctcactccagcttcaggtagccatcagtagggcctggcaatatacactgatttggtttgttttatttttgtctgcaggtgaaatccctaagagctctgccatgtactccttgtgacccttgccttccaggaaccatgcaagaagcgcagccaccagaagtccttaaaacagcaggaaacgtgggcctgtcccccttttgtgcagctacctatctgctgaggagcttctgggcctcattcctccaagtccacgggagggtccagaagagggggtcagagatgtatcctggtggagctgggagaaaaccagaaagcctttctgacagctatggaataccgttagccaaggtccacttggcccagcactaagcaaaagatgcgtagtttgcatagaaggttttgtgatactgcttcccaacagccccagcagcttgggaactagcaacaacacatttcttgcctcatcagctgtcctgagatggaaaactcagtggatataggaccctgattacgatgaatggggcacatggtcccaatgctggagctcctctggcaggttctaaaagcacactactgagcagcggtgccctgctggacactgctggcaggggctcagtgagcactactcacagatccacacctgaccctgttgggtccagtcagactgggccttggtctgcactgtagcacctgtgttctttgagttcacatcatgaatgtgacttcccagataccatttcaggcttaacctagcacatcctatttcttttcttctatgatatccaaattggactgacctcacttcaaatactctgtcccattttgtcaccctgtcttacctcagggaaattggggactgatggccagaccaattctgttgaaattcttgcatagagcaaacctgtgctgatttttaagtggcatgggagaggcccccagccacagtaaagcctagtctgtgtcttcacagtgttgatagaatctgcttgtgtgtataaatgtatgatatagatttacatatgttgctatcgccatatattgaaggccaacataactggtggacagggtaggtgagagaaaatgaaagtctttttggtgattattaaagcaaaatgtgtataaagaaataaatagtttttctttcactgctttgtttcccatttctgcaccaatcccttgacagtataaagaactggaaagagaaaatgggaaagacaaactgtgtttaagaagtgcatagtctaatgcttgaactctgactttaaaagattaaggttttccttctttgtcattttgtaagaatcctcagtctgaaaatatgaaagaatggttcttaaacttggtgtaccttagaagcagctgtgaagattacaggaactacctcctggtctccaatcccaggagatttagttggtgtgagccctagaatctgcattttttaaatataagcaccccaggtgattccattacatgtgggctgcagatcacagtttaaaaaaacagtgttctataacattgaatcaaaactaaaactacatttaaggaccttgaatcaaaaagtatgtcattccattaatatttgtataaaaattttaaaatattccttgggaaaagtccctagctacatgcttttgatccccaagattaaaataaagctatcacttcacaattatttactagaagcatttaaaaaataaacaggtagaaggtggagtaagatggtagaatagaattctccagcaatggtgtctctgaaggaacatcaaattgaacaactatctatgtaagaaaacaatttcacaaaggctaatcaggtgagagatcatagcagctggttttaacatgataacaagaaaagatgcattgaagaagggaggacggacacttttccattgcctatgacacctctcccccaaccacaggaaatgcatctccgagagagaatctaatggcttggggacaaggaggaaagtgtgggactttatattgaaacttagtaccagtcttgccatagtgacacatggcactggacaaaaccccacagcacttgattccaggctggtgcccacaaaagaagcatttagacccactctgggccacaagggaatcagatgccccagcaggaagaacccaccaaagttctggccggctttatctctggaaatttattgggctacaaataaatttcagtggcagccaggctgtagttcagaggtgacagcatgctggcagccctcacagccctcgctcactctcggtgcctcctcggcctcggtgcccattctggccgcacttgaggagcccttcggcccgccactacaccacgggagcccttctctgggctggctgaggcaggagccggctccgtcggcttgtggggaggtgtgaagggagaggcatgggtggaaaccgggctgtgtgagacacttgggggttagctggagttccgggtgggcatgggcttggcggccccgcaatcggagcgggacttagcaccctgggcagcagctgcggagggtgcgccgggtgccccagcagtgctggcccaccagtgctgtgctcgatttctccctgggccttagctgcctccctgcggggcagggctccggacctgcagcccgccatgcctcagtcccccacagtgggctcctgcacggcctgagcctccccaaggagcgccgcctcctgctccatggctccaggtcccatcaaccgcccaagggctgaggagtgcgggtgcatggcgtgggactggcaggcagctccacctgcggccctggtgcgagatccactgggcgaagccagctgggctcctcagtctagtggggacttgggagaaactttatgtctagctaagggattatgaatacaccagtcagcactctgtatctagctcaaggtttgtaaatgcaccaatcagcatcctgtgtctagctcagggtttgtggatgcactctgtatctagctaatctggtggggacttggagaatctttatgtctagctaagggattgtgaatgcaccaattggcactctgtatctagctcaaggtttgtaaatgcaccaatcagcactctgtgtctagctcagggtttgtaaatacaccaatcaacactctgtatctagcttatctagtggggacgtggataacttttgtgtctagctcagggattgtaaaggcaccagtcagcaccctgtcaaaacaaaccaatcagctctctgtaaaacagaccaattggttctctgtaaaatggaccaatcagcaggatgtgggtggggccagataagggactaaaagcaggctgcccagccagaagcggcaacctgctcaggtccccttccacgctgtggaaagtttgttcttttgctctttgcaataaatctagctgctgctcactctttcggtccacactgcctttatgagctgtgacactcactgcgaaggtctgcagcttcactcctgagccagtgagaccaccaacccacgagaaggaagaaaccccgaagacatccgaacatcagaaggaaaaaactctggacacgccacctttaagaactgtaatacccaccgtgagggtccgtggcttcattcttgaagtcagtgagaccaagaacccaccaattccagacacatagtgactgcagtccttgggcaagccctgaagctgcataggtctggaagaccctagacttgaggtgtaagccagtacgacagcagcagggcagcagctatgggaatgtctgtatcacccctcctcacactccaggcagtgcagcctgaagagagattccttttgcttgggggaaagaaagggaagtaagctagaggctttacctaggaatgtagagaacaatccctgaacttccccaagtccacagggctggggacctaggaatctataagaattgcagtgtacctgggctttgaatgccctgtagtataagaatggctgcagtgatcactggcttagggaactcgtcagcccactttgaattcctggaaggtcctctgaaggacaggtacaaacaagacctgactgcaaaggctggaataaataccatattctccaatgcccagatattgaccaacatctacagtatcaataacatttaagtcaatatgacctcaacaaatggaccaagtaaggcacccagtgaccaaccctggagaggtggagatgtgtaacctctcagggaattcagaatagctattttgagaaagctcaatgaacttcagggaaacacagagaagcaattcagaaatatatcagaaatttaacaaggatactgaagtaatagaaaaaaatcaaacaaatcctgggctggaaaatgcattagtgggtctcagtagaactgatcaagcagcagaaagaattagtgagcatgaaaacaagctatttgaaaatacagtcagaggagaaaaaagaaaagaagaacgagaaggaacacagaatgcttaagagatctagaagagggcctcaaaagagaaaatcaaagattcattggccttaaagagacggttgagaaggagcaaagagtagaacccttattcaaagaaataatctttttttaaaaaatactttaagttctagggtacatgtgcacaacgtgcaggtttgttacataggtatacatgtgccatgttggtttgctgcacacaccaactcgtcatttacattaggcatttctgctaacgctatccctcccacagccccccaccccacaacaggccccagtgtgtgatgttcccctccctgtgtccatgtgttctcattggtcaattcccacttaagagtgagaatatgcggagtttggttttctgcccttgtgatattttgctgagagtgatggtttccagcttcatctatgtccctgggaaggacacgaactcatcctttttattgctgcatagtattccttggtgtacatgtgccacattttctttatctagtctattactgatggacatttgggttggttccaagtctttgctattgtgaatagtgccacaatgaacataggtatccatgtgtctttatagtagcatgatttataatctttagggtatatacccagtaatgggattgctgggtcaaacggtatttctagttctaggcccttgaggaatcaccacactgtcttccacaccggttgaactaatttatactcccaccaacagtgtaaaagcgttcctatttctccacgtcctctccagcatctgttgtttcctgactttttaatgatcgtcattctaactggcatgagtggtatctcattgtggttttgatttgcattccttaaatgaccagtgatgatgagccttttttcctatgtctgttggctgcataagtgtcttcttttgagaagtgtctgttcatatcctttgcccactttttgatggggttgtttttttcttctaaatttgtttaagttctttctagatgctggatattagccctttgtcagatggatagattgcaaaaattttctcccattccgtaggttgcctgttcactctgatgacagtttcttttgctgtgcagaatctctttagtttaattggatcccatttgtctattttgactttcgttgccattgcttttggtgttttaatcatgaagtctttgcccatgcctgtgtcctgaatggtattgcctaggttttcttctagggtttttatggtgttacatcttacatttaagtctttaatccaccttcagttaatttttgtgtaaggtgtaaggaaggtatccagtttcagctttctacatatggctatccagtttccccagcaccattcattaaatagggaatcctttccccattgcttgtttttgtcaggtttgtcaaagatcagatggttgtagatgtgtggtgttatttctgagggctctgttctgttccattggtctatatctctgttttggtaccagtaccatgctgttttggttactgtagccttgtagtatagtttgaagtcaggtagcatgatgcctccagctttgttcttttggcttaggattgtcttggctatgggagctcttttttggatccatatgaagtttaaagtattttttttccaattctgtgaagaaagtcagtggtagcttgatggggatagcaatgaatctataaattaccttgggtagtatggccattttcatgatattgattcttcctatccatgagcatggaatgttcttccatttgtttgtgtcttcttttatttccttgagcagtggtttgtagttctccttaaagaggttcttcacatcctttgtaagttggattcctagatattttattctctttgaagcaattgtgaatgggagttcactcataattttgctctctgtttgtctgttcttggtgtataggaatgcttgtaatttttgcacattgattttgtatcctgagattttgctgaagttgcttatcagcttaaggagattttgggctgagatgatggggttttctaaatacacaatcatgtcatgtgcaaacagagacaatttgacttcctctttttcctaattgaatacgctttatttctttctcttgcctgattggcctggccagaacttccaatactacattgaataggagtggtgagagagggcattgttgtcttgtgctggttttcaaagggaatgcatccagtttttgccctttcagtatgatattggctgtgggtttgtcataaatagcgcttattattttcagatatattcaatcaatacctagtttattgagagtttttagcatgaaaggctgttgaattttgttgaaggcattttctgcatcatttgagataatcttgcggtttttgtcattggttctgtttatgtgatggattacgtttattgatgtgtgtatgttgaaccagccttgcatcccagggatgaagccaacttgatcatggtggataagctttttgatgtgctgctggattcagtttgccagtattttattgaggattttcacatccatgttcattggggatattggcctaaaattatctttttttgttttgtctctgccaggctttggtatcaggatgatgctgccctcacaaaatgagttagggaggattccttctttttctattgattggaatactttcagaaggaatggttccagctcctctttgtacctctggtagaatttggctgtgaatctatctggtcctggaatgtttttgcttggtaggctattaattattgcctcaattacagaacctgttattggtctattccaggatttgagttcttcctggtttagtcttgtgagggtgtatgagtccaggaatttatccatttcttctaggttttctagtttttttgcatagaggtgtttatagtatcctctgatggtagtttgtatttctgtgggatcagtggtgatatcccctttttcattttttattgcgtctatttgattcttgtctcttttctcctttatgagtcttgctaggggtctattttgttgatcttttcaaaaaaccagctcctggattcatttattttttgaagggttttttgtgtctctatctccttcagttctgctctgatcttagttatttctgttttctgctagcttttgaatgtgtttgctcttgcttctctagttcttttaattgtgatgttagtgtgctgattttagatctttcctgctttctcttgggggcatttagtgctataaatttccctctacacactgcttcaaatgtgtcccagagattctggtatgttgtgtttttgttctcattggttccaaaaaacatctttatttctcccttcatttcgctatttacccagtagtcattcaggagcaggttgttcagtttccatgtagttgtgcagttttgagtgagtttcttaatcctgagttctaatttgattgtgctgtggtctgagagacacattgttgtgatttctattcttttacattcactgaggagtgttttacttccaattatgtggtcaattttagaataagtgtgatgtggtgctgagaagaatttatattctgctgattaggggtggagagttctgtagatgtctattaggtacacttggtccagagctgagttcaagtcctggatatccttgttaagcttctgtctcattgatctgtctaacattgtcagtggggtgttaaaatctcccattatgattgtgtgggagtctaagtctctttttaggtctctaagaacttgctttatgaatctgggtgcttctgtattgggtgcatatatatttaggatagttagctctccttgttgaattgatccctttaccattatgtaatggccttctttgtctcttttgatctttgttttttaaagtctattttatcagagaccaggattgcaacccctgcttttctttttgctttccatttgcttggtagatcttcctccatccctttattttgaggctatgtgtgtctttgcacgtgagatgggtctcctgaatatagcacactgatgggtcttgactctttatccaatttgccagtctgtgccttttaattggggcatttagcccatttacatttcaggttaatattgttatgggtgaatttgatcctgtcattatgatgctagctgtttatttcacccattagttgatgcactttcttcctagcattgatggtctttacaatttggcatgtttttgcagtggctggtactggttgttcctttccatgtttagtgctcccttcaggagctcttgtaaggtaggcctggtggtgacaaaatctcttagcatttgcttgtctgtaaagtatcttatttttccttcatttatgaagtttcgtttggctggatatgaaattctggattgaaaattcttttctttaagaatgttgaatattggcccccactttcttctggcttgtacagtttctgctgagacatccgctgttagtctgatgagcttccctttgtgggtaaccctacatttctctctggctgcccttaacattcttttttttgttgttcatttcaaccttggtgaatctgacaattatgtgtcttggggttgcttttctcaatgagtatctttgtggtgttccctgtatttcctgaatttgaatgttggcctgccttgctaggtttgggaagtactcctgaataatatcctgaagagtgttttctaacttggttccattctcctgatcactttcagatacaccaatcaaatgtggatttggtcttttcatatagtcccatatttcttggaggctttgttcatttctttgtactcttttttcttgaatcttgtcttctggctttatttcattaatttgatcttcaatcactgatatcctttattctgcttgatcgaattggctattgaaacttgtgtatgcttcactaggttcttgtactgtggttttcagctccttcaggtcatttaagctcttctctacactgtttattctagttagccattcatctaaccttttttcaatgttttcagcttccttgcaatggattaaaacatgctcctttagcccagagaagtttgttaataccgaccttctgaagcctacttctgtcaccttgtcaaactcattctccatccagttttgttcccttgctggtgaggatttgtgttcctttggaggagaagaggtattctgatttttggaattttcagcctttctgctctggtttctccccatctttatggttttatctactactttggtctttgatgttggtgacctatcgatggggttttggtgtggatgtcctttttgttgatgttgatgctattcctttctattggttaattttttttctaacaggcaggcccctcagctgcaggtctgttggagtttgctggaggtccactccagaccctgtttgcctgggcgtcaccagcagaggctgcagaatagcaaatattgctgcctgatccttcctctagaagcttcatctcagagggacacccacctgtgtggggtgtctgttggcccctactgggaggtgtctcccagtcaggctatatggtggtcagggacccacttgaggaggctgtctgtctgttatcagagctcgaatgtcatgctgggataaccactgctctcttcagagttgtcaggcaaggatgtttacgtctgtagaagctgtctgctaccttttattcagatatgctttgcccccagaggtggaatctaaagaggcagtatgccttgctgagctgtggtgggctctgcccagttcaagcttccctaccactttgtttacactgtgaccatacaaccacctactcaagcctcagcagtggcagaacccctccccctgccatgcttcagtgtatcaggttgatctcagactgctgcactagcagtaggcaaggctccatgggtgcgggacccaccgagccaggcatgggagggaatctcctggtctgtcagttgtgaagacagtagaaaatgtgcagtatttgggcagaaatgtactgctcctccaggtacagtcactcacagtttcctttggctaggaagaagaaatctgccaatcccttgtgcttcccaggtgaggcaatgccccaccctactttggtttgtcctccatgggttgcacccactgtccaaccagtcccaatgagatgaacctggtacctcagttggaaatgcagaaatcatccatcttcagcttcactctcactggaagctgtagactggagctgttcctattccaccatctttgaagcaaccgtctttttttttttttttttttttttgtatttttggtagtgacagggtttcaccatattgcccaggctgcgtttcaaactcctgaggtcaagccattcattaaaacaaacctatatttgttttatctgagttccttcctcaggaaaggaccctcaggcctctcagaaagcatcatagacctgaaactcagctgatcacagcctctagacaactagatgccagaaccctcactcaacatgagtgcttcctcaccactccctagttcctcttttcccacacacagttacatttcttccctgctatataagcccccaactttagtcaatcagggagatagatttgagactaacctcccatctccgcagccacagcaccgatcaaagccttcttcctcagcaatactcaatgtctcaatgattggctttctgtgtgctgagcagcagggcctacactgaacccctggggttttggtaaaaatacatgtaccctttcaaaaaccgcaattaatgggttgtggcatattgaggaattggaatggcgtcaacttggccgattctgagaaaacacactgtgcttaagtgtcagggccctgcctcctgaccttggcagtttatggttgattttgaggcacagcaggggtgtgtggcctggtttgagtgttttatagaaatgtaaaatatgactgatttatttgtattttaaattcaacaaatctccatttctggtgagaaaatcttgccaaaaccaactaaacaaaggcatagacgtatatgaagaagaaaataaaagactccttgcctcccaatcccacttgcttggtgtcagccattatttattacatggaggaaggggacaaggcacccaggaagtcccaagtcctgttctgacaatcatgtggcctcactggacaaagggaaaagagggaaggcaaaaagaatgtaacactacagtttgcagaaatttccctttggtagaggaaacactggtaagctgagagagtatgttttccaggagggaggcctcaaagggctcttctctggccctaagcccaaactggattttgcctcattttctgaggtgcaaatgaaatgataaaagttgatcaaaggagagggcagagagaaagaaagaggacaactcctctctcgcaggtccaccttccttggtgctgcttgagggatcagaagaaatgccttaacataggtgcatgagaactatggctgctaaatatgaacttagttacctccagttacaagctagtgtgaggttccatggtgtaatggtgagggctttggactctgactacagtgatcagagttcaagtctcagtgggacctttctgtataattccagtgaggttcctctctattgctcccgagtggaatgggggaaattgccgcaatcgtggtcatggaccctccaggccactggctatatgcaattggagtcctggacccagtgacccagcaagacccctcccctctcagggtgaccctgggcttccaggtcagaggtctcctccactaaaaaggctgccttccctcaatcctagaccccgagttttcttttactcatgtcatcgggccgctgccctgtgtctctttggaagaaattacctacgtgaaaaactttactttcaggattccctaattccttcatcccataggatggtgaagtttttaattcctgatattgggtcaagttctaatgcgcacattgctttttgttttcatgggatcccttccaaccagctaccagtggatttctgtcttggggtctctgtggatggcaactagatgctgctcttgtctgaactcctgacacctctctgcagggaattgcctcccttagcctcctaaatcagtcaacatttagatttgagcctggaatcccagcatctgtggagaacagaggttcctgatccctggccagctctccctcagtgaaggggggaggaagagagcagctgtaaggtgcaagtctggggccctgggcaacccccttcttcctgcccagactctgctccaaggagaagttgccttaggaccagatcagatggaaactcttttgttctcttctcatcaacagaaaaatttagacaagaactctggaggaccttcctagcttatacaaatggtgtggccaaatctctccagttttggaaatgtccaagtttaccaagtgttttgagggctcactttggagcctctgaaaaggaggggtgagggcccacggaaggtacctgagggatgcaggggagagaggggaaaaagcagacagaagggaggagagaaggagggagggggagaaagggtgtgtgagggccaggagccaggattcaccctgacagttcagtgactgctccctgcccccaaggttcccactgtggcaccttccagcaggtggtttccatctcttattgatatcctaagaacttggtcctacggaacagtcccaccctatttgtctggcatgagtcctggcagtttcttttcatcttttgggggatcagatgggggtatataggtttgcaagtgacaaggagctaagtcaggaccttgtgaagctgctcagagttaactgtcaagcagcctcctttcccccttcccctgaaggatgattgcctgcaagacagggcctggaggaggccagggcacccaaggccacagaaatgccctgggatgagtcccggcaggagatgccttggctgagctgactgtgcacttccagggctcacaggggtctggccaggagactgagcaaggggaccagggaggttatgcagaggcttctgcacagcaaagcagacattcttcttggagcccccaacccaaatcaggtcttccacctcctcttcctaaagaccctttactgcagctattcttttactagaactacaagtttataggacatagatttcagtgccctcatctggccaaccatcttcagctgccaatgcccagggtaacctccctccctaccaagacctgactcaggaccttaccttaaggagaagatgtcctgttctttctttcccacaagaactgccctagctcagaccccatttctgtctggtgaccaggacagtcccctcaccagtctcgcaggttggggagggcagattctcctcagctccctgcccctgagagaccccaagagtcttgtgtggctccagcccacagagggatatccatggcccatatctctcaaaactctcccctcccactctgaatccaccctctactgcatgctcccctcacagaacagacactttttttttgttttttgtttttttttggcctatcctttttttgcctacccgcatcccagattgacttttctgtcttagaactacctttccctctttggacagtgtttttctggtatacacatgaagatgtcccactctcccctgctcaagaagagagtgcctgacctaagctgggcccatcagatccagtacttacctggaataggaaaaagacggggagggtgaccaaagattacaaaaatctctgaagcttatccacttgagaaagagtccctgaagatactggcctttcattcctgctatgtatatccaatgtgactgaactctgaataaaatatacaagttataacaatgtagtaattgacccagcaaactaggacataaacatgttagagggtaaggtagtgagaggcatgtttgggggtggtggtgatgagcaagtatgtgaaggagagatagtgcctaaacttgaaaatcaaaaagtaataatatatatttagacataaggagataaataactaataattgtttctatgtgatgaaactctgggagtatacaaagggactgctgttgtactaaacaaattttctagtataaataactttgacaaagtatccaaataaaaaaatcctttctcatatatgtatgtgtgtgtgtgtatatatatatatatatatacacacacacacacacacacacatatttgcattctttgcattttgaatataaatttttatacagtcatgttaatccctcttttcttttaaggatttgagtttgatgtcatgcatacaatgtgatcccactgtatgactacagaaatgttagcaaagtaagttcagaagacatggtaggaaaatacttcccagttttggccagaagatggagaaaaaaagaattctcataaaatgttaaaagtatgacttgttatatcttcttttcacagtaatttagacagaaattagcaaaatcagaaaggtatacatactttggtctgacagttccatctccaggtgtctacggagaaatagacaagcgatgcatgacagatacatgtgtcagtctggtccctgcagttgtatttgtaataatacacattggagcaatttcatggccattggttacagaatgtttgaagaatgatccattcatatcaagaaggatatttcgaagatctaagcctgatggaaatgctggaggccatgacactgataggagctcatgcgtgttgaccaattactacgtgacaggcattggctccacgctcatttaaattttggacaacctacgtgttctgatttagcctattggacagcaaatttgacagaaatggaggcacagaaaattaatgtgtttaacttcaaactctggtagattaggtttttcacccagagcctgtggcttcaccatagttgtgattcaggttctgtcattttccacttcaggaatttccagtattccaaatatgagaagctgagaaaacaaacaaaccaactcaaaaccctaaaagccaggataagtaagggtagatgtttgttgggtgtggattaaaaatggacttttttttgcctcaaacaacaaagaggcacgtcggaaaatagacaagagacaagaagaagagatttaagagatatttggtccaaggaagagactcttcagatggaaggtcatgtcagctagaaacattaatgtgactggatgggctcaaaccactgacttttcagtcaacatctgacagcactaacctaatgtttcagagacactgcttgttaaacagtgaaagctgttgctcaattgtgtcatccataattgtcaaatattgccatttagtagcataaggaagtattctctgttgccaggctagagtacccgtaactcttctgttttgttgaacattcttccccaccacaaaccctctttagaagactgggggctcctaaaacattgaggctaagagtcctgtccttgtgcatgtttgggcattgacccagggccaaatcagtggtagactcctccatgcatatgccaggtccccaggtgacaactgcagtctctggatctgaggtcatccactttcccattcctagctcacctcgcccattgtgaagcctggttagtattgccagagacccgagtggacaggtgcccccaccaaagacagaacctgccatgtgcccatcttgctgatccctccatccttctagacaaaggcttcatgagccagggaccttgggtttgctcacaagacagcccctcacctagtatgcattagctcattatgtgtatgtatgtgtatatgtatatgtatatgtatatgtatatgtatatgtatatgtatatgtatatgtatatatgtgtatgtgtgtatgtatatgtcctcaggttgtattccttaaatatatatatgtaattccttaaatatataattttaatatgaaattttaaaaaggttcctttaataaacatttacaataacatcaagaaatataaactatatagcaaagatgtgaaagccagccaggctctcaatagcatcaagaaatataaactacataggaaagacatgaaagccagccaggcttggcttcaaatcccaacactttggaaggctgtggcaggatggtcacttgagctcagaagcttgaaactatcctaggcaacatagtgagaactcatttgtattgaaaatcagaaaaattatcccggtgtggtggtgtgagcctgtagtcccaggaactcagtggatgaggccctaggatgtcataggcctgagaattccatgctacagtgagctgtgatcatgccactgtactccagcctgagtgagtaagatcgtgtctagaaacaaaagaagaaaaagaaaagatgtgaaagcctatatattgaagactaccaagtattgctgagagcagttaaagacatttggaatagagaatgctccttcttacatttcaagattgcttttgttttggggggacacttgctattttttgagaatatgaagttcttcttaggcattcctgtaaaaaaggccactttttgataggattgtattgaatctgtggattgcttttagttgtatttttatcttaaccatgttacaacttccaacccatggacacaagatatctttccatttatttagctcttccttaatctccatgagcagtgttctgtagctgtctgtgtacaagtactgcacctccttgataaaaattattcccaggcttattatccttacaggtgctattacaaatgaaattgtgtcaattttcttctcagattgttcattgctaacacaactgattgtttgctgaaagtttgctgaattcacttactaactctagtagtgtgtgtgtgtgtgtgtgtgtgtgtgtgtgtgtggtctctgtgtgcatgtaagtgtgtttacatttgtatgtattatttgggattttctatatataggatcacaccatctgcaaattgagatcattttgttttctgttcaaaaatatttttctcatgtttatttttgaaagataatttggccaagtgtagaactgtagacttcagtttttctttttttaagtactttattgcaaacttcttgtttgtaaagtttcctatgagaaatcttatgccatccttatatttagtgctctgtatgtaacatgttctttccccttttattccttttaagatttcctttttatcactggttttgatggatttgattaaagtgttccttggtgaagttttcttcatgtttcttcttcttagaataatcgtatttctgtaatatttgaagtttatagtttccatggagcttctaaatctttcatccagtatgttttaaatatctttgtttcccttctccactacacgcccttcagggtttccatttatccttataccaggatgtttaacgtttttatgctgatggtctttttatgttttcaagtcatttgttacagtgtgtttcacttatgttagtttcaacttctattccagctagttcaataatcttctcttctgcaatgtttaatccagtgtcttcttccatttcatactgtaaatcatagttcttatctacagaatttaatatttaaaaaatcttcaacctctccatttaattaaaatacaattatactaactgctctaatatccttttcttctatttccaacgtgtgtcaatttcaactagattattagattcttcattgtgtgttaagttttcctgcttctttggctgcttgatattcttttatttttgttttttttttgggaggggggaggatggagtttcactctcattgcccaggctggagtgcaatggtgtgatcttggctcacagcaacctctgcctcccaggtacacaagcgattctcctgtctcagtctcccaagtagctcagattacaggcacgcaccaccatgcccggctaatttttttgatttagtagacatggggtttcaccatgctagtaaggctggtcgtgaactcctgacctcaggtgatccacctggctgcttgatattctaagatttgatgctgcagctttggtgtcaatgctcaaaagtgcccaaagacaccacttgacctcagtgtctatgcacacccaagcttttgcaacaggacaggtagagagggcagagatgagtgtgctacaacatgctggtagagggcacctcaattttgcttggggctttcctatgtttcatagaaaaatgtgttttccttaatttttcccataagaaccaccctacttcatgccctgtctctctgtccaaacaccaggacagtcctctcaccagtctcaaccacccaatggattgacaaatgtccaaatatgattcagtggagaaggcattctcttgtcaacaaattgtgtagaaacaactggacatgcatattcccaaaggaaaaaaattcacctgaacctcaatactgactcaaaaactaactcaaaaaggattatgcaactaaatataaactataaaactagaaaaagtatagcagaaaatgtaagacaaaatcttcatgacacagagttaggcaaggtgttctttgttttcaataaacacaaaccattaaagaaaacattgataacttcaactttataaaaattaaaagtttttgctcaacacaagacagtaataagagaacaaatataagctgcagattgggagaaaaacagtggaaatcacaaatatgacaaacggcatgtgtgatagttacttgtacttgtcactgtgaccgagcaccatggtactgggacatttggccaaacatgattctggttgtgttccagagagtgtttcggatacaattaacattgggatgggcagactaagtgaagcagattgccctccttaatgggggtgggactcatacgtacaatcaaatgccaggagacaattaagaggcctaatggaaaacaaatgctttcctgggtatccagctttccttccatcttcggaatttcagcctctataacctcagaagcaaattcatatatatatatatatatatatatatacacacacacatatacatttcatagttatgtggctaagattgtatttttaaaagttcagccatgagatgattggtgaagccagtcaatgaataagggtgtgttctattatatgattcagtcttcttttgtacacgatttaagttctgcatttgaagtaggaggatgggagagagtaagtccacctaggatgataacagttgaatttctcaacatacacttcaaagccctagaggttaacttagagagtcaaaaattccacccataatcctgcccctacacactagggctagggaacactgtggctctcaggtgattttatttagccaggtctgggagccacacaacagcagacggagcaggaaacactatgcaaatagaggccaggacagcagggagagcctgttaatgacagaacacaggtaaaactatcctcagaagcaagtgtggagaaacacagatgatgcctgagacctggtggattaaagcactggctactggggaattgaaaggaaggggcttcaccatgcagaggaccagaagtgccaatcttggaaacgcagaattcctgggagatggggaggcgtggaccatggaagtatcctctggagactcgtggtgaagagaacaaatgaatgaagtaactggcagaaattagagttcctggtagaacaaaatacaatcccacaatgagaacatacaccatgtatgtcccccaaggaagacaatgtctcctaaaaactcaagaaaatcattttgggcaagcaccttatatccagtaatgcgatccatgttttaagactgtgagaaaagattattaaacatgctaaactcagtgagatccaattccctcaggaggactctgttaaggatgagtaccactcagcaagtgatgactgtgacattcacttttggacagctcatgagcattaatatatttaattgtggatctaaactaaaaaccaaggtggagacaagatgacaatcacagaatgtcactggtatatgtttagcttcaaatactattatgagaagtaacaggtaaaggaggtgggaaaaagaaaacacattatgtaactgactgtcatatggaaatatttgatgctgaaagttataatttaaaacgtataaaccaaatattagaagtgtgtctagttcaaaggggggaaaccatcaaaaacatttttagtgcaatatttagcatgagctctacaacgcttcctaaatgtcagaggcacacacagacacacacacacactcactcacaaagaatacaaataattggaacccagaaaagtagtaaatacattctgctacatatggtaaacatagcctacaatgtggaagagattagaaaataaacagggaaatgaaaatgtttttattaattcgcatcagtatccatgaaaaatagtcagcataataaaagattataacactgaatgtaaaaaacaatccagcagttcagagtgataggcaaaagtttttaattgtatagattcaaattaactttggacaaaagttaaaactcaggcagagaatttttttttcaacaacagacactaacaaaaacaaaggcacagtaaaaattgagacagaaaatttgcagtgtagaggtatgaatctaatgatagacacaggcatggatgattaataaatgataaaatgtttagaggatgatcactagaatacaggacatttatacttttaaaaaccactttcccaaatacttcattataagtaagttgtctctaaaagggacagatcttctagacccctccttaaccaagtaactagtcctgatgtcatgataatggtgatggacaaactagaccttctctgcgcgcagatgggctgaggttggaagctcacagcattgactctgcagtgttcctggcaaaacgtttaggctgaatttaatcatgaagacattttcaggcaacttcagaatatagatcattgaaccagacagctgacctgtcctctacaaacaagtccatatcaccacaatcaatgacaacaacaaaaagatgaggaaatatttggggttcaaaataactaaagaaatgtagctacattatctttttacgtttttttgaacccaaaatgtctcttctcctttttgttgagtgattcgtggtgacatggactgtgtgaaggagacaggtcagctgtcctgctcagtgctctacattatgcagttgtctggtgattaacctaatatgaaactcaggccaagcactttctgcaagaacatggcattgttcacattctgcaccggcagattccgaggtgacatgctgtctcctgccagtggctcctgactcctgttctctacaggataagaattgagaggagcatggctacagcctctcaatgctgtttgtccatctagatgtggtcttcctaagtattgatatcaattggaggctgaaggactgtagcttctgtcaccaaaggagcctagtgggttacaattgtcaagagcagtcagtggttctgaaatacaattctcagcgaaggatccctcctgggttacagatggatcagctaaaacaaaccaacactgaagatacaaagaatggggttaggttcactgaaactagggtaacacctttgcatgagctaaacacaaagatgacactgaccttgagcaggcatagaaggtcagagacatgcctgcaaaatgaaatccctgcggaactttgtagctacccagagatatgtggttcaatttagaatgtctgacagatcactcctggcatgtgctgcatagttatgtgaacgtgtcacacctaactttggtccaatgtcttcagacttagcacaggttgccactggcatggtctgagaataggaatagagccatgcccactgacccatcctatgcctgggcttcgaaatggaactatagtttcattcaaacctacatgtgcctataggtcctgcctgcagcaatgacatctctcagtttagtaagggctgcttagtgtgggaatatgactcccatctggaagaccaggtggagacttatcaccatcaaagtaaaaaacctattgtccacttcaagggcaaagctgctgtgctgttccttaaatgagtaaaaggcacttctgtagtgctggaatgagtcaggcagttcaaagtaagttggaggagtcgaataacatctatccagtgaatcctgcaagacttcaggctcttccacttccatcagcaccccgttgagcctgggaaaggagactaaactaaagaagtagccagggaaaatcagacaccacagagccccaactagatttccggggtaaaataaggaagtggttaaaaaagaaaaaggatagatccattaatgaggcaaaaaattattgcctttatgttgggatagaacagggccaggtagaaaacaatgaaagagaaagacagagagagagacagacagacagagagagagagaggagagaaagtgagctcagtgaattggccaggtgacacactgataaaggagtaaaaagacattttgagttagtgccctcatgacacacagcaaaagagtgagctcttcagttttccataaaacttgctcaaaattcgatgcagtcaccatgaaagtacagcttttgaggtacagtcaacccatggtacattagtaaatgataaggggaggaagaaatgaaaacctaaatgtctactacaatgaaaaccaacagcaatgtcagtaggagtgattcagccttcgttgaaaacatgaaattaaacacaccctgttttccctggatctgtcatctccaggtgttaacacagaattaagcatctacaattgctgaaagttacctggggcatggtgggttctgatcttcttccccttcttggtacttttcaatttctgaaataaattcagacatggacagacacaataagctgattcccctacacacataacaatccactgtctaatcctcaaacagggacctcaggctcctcagtataagaataggacactgtgggagatatatttcaggaggcctgaaggctgctcatgatagagattccttggtttttgtcccagaaactaagggtaaaatgtccctattctggtagattgttatcccaatatcatttgtcccaagtttgtgcaaatggttatgccatatttttccgatcaatttaaagcaaatgccctcaaatgatttctaggagaaaaactgcaataatcagccctgtttcatcaaatactcaggttgttcatggttgtgaggattttgactgaaaaaggaaaactacaaacccttgagtcgaaatcatagttctctgaatttgtcacatctgcccaggtccaatgtcttgagagtagaatctgagtgccacaggcatggcctgagatgaggaagagagccacgctcactgacccatctcatgtctgggcttccaggtagaactagagtttcattcaacctatgtgcctataggtcctcactgcagcaatgacatctctcagctcagcaaaggccaattggagcaggaatatgatctctatatggaagactcagtggatccttattgccttcatagaaagatactcaccatccacatcaagagaaaagccaacgtgttgttcctccaatgaggaaaaggaacttccatagggctggcatgagtcaggcagttcaagataactggaaggagtcaaataacatctatccagtgagtcctgcaaaacttcagactctactacctccagcagctctctgctgcgcctgcaaaagtagaaaaagtaaaggataagccaggggaaatcagacacaacacagccccaactagatgtcatgggtagcataaggaagtggttaaaaaagaaaaaggatagatccattaatgaggtaacaaattattgccttcatgttgggtcagaacagggccaaatggaaaagaatgaaagagaaagacagacagagagatagacacagagaaagagagagagagagctcagtgaattgtccaggtgacacactgatgagggagtaacaggacactctgagttagtgccctcagaacacacagcatacagtgatcatgaaaagactgtgctcaataattttccataaaatgtgatcaagattccatgcagttgccataagaatacaacttttgaagtctggtcaacctacagtaggttagtaaatgataaggggaggaagaaatggaaacttaaacatctactgtaatgaaaaccaacagcaatgtcagtaggagtaattcaaccttcgttgaaaacatgaaatcgaacacactcttgttttccctggacctgtcgtctccgggtgtcaacacagaattaagcatctataattgctcaaagttacctggggcatgatgggttttggtcttcttctacttcttggtacttttcaatttctgtaataagttcagatatggacagacacattaagctgattcccctacacacataacaatccactgtctaatcctcacacagggacctcaggctcctcagcatgagaataggacactgtgagagatattcttcaggaggtccgaaggctgatcatgatagagattccttggcttttgtcccagaaactgtgggtaaaatgtccctattctggtagattgttatcccaatgtcatttgtcccaagtttgtgcaaatgattatgccgtatttttccaatcaatttaaagcaaatgcccccaactggtttctaggagaaaaactgcactattcagccctgtctcatcaaatattcagattgttcatggttgtgaggatattagacactgaaattagagtgaaggaggaaatctacaaaactgagacaaaatcagagttgtgtgaatttgtcacatctgcccgaatccaatgtattgagagtaagatcagggtgccacaagcatggcctgagactacaaagagagccacgctcactgatccatcccgtgtctgggcttccaagtagaactagagtttcatttaaatctacatgtgcttataggtcctccctgtggcaatgatatctctcagctcagtaatggccactagcagcaggaatatgaccctatccagaagactcagtggatccttatcaccttcatagaaaggtactcaccacccacatcaagagccaagctaacatgctgttgctccaatgagtaaaatgcacttctgtagggctggcatgagtcaggcagttcaagataactagaaggagtcaaatatctatccagtgagtcctgcaagacttcaggctcttccccttccagcagctccctgctgagcctagaagagtagaaaaagtaaagaataagccagggaaaatcagaaacctcagagccccagctagatttcatgggtagcataaggaagtggttaaaaaagaaaaaggatagatccattaatgaggtaacaaactattgccttcatgttgggactgaacagggccaaatggaaaaggatgaaagagaaagacagtcagagagagagagagacagctcaatgaattgtccaggtgacacactgatgagggagtaacagaacactctgagttagtgtcctcaggacacacagcatacagtgatcatgaaaagaatgcgctcaataattttccataaaatgtactcaactttccatgcagtcaccatgagaatacagcttttgaaatatggtcgatgtaccgtaggttcataaatgataaggggaggaagaaatggaaacctaaatatctactgcaatgaaaacaaacagcaatgttagtaggaataattcaggcttggttgaaagatgtaatcgatattgtcagcccactctgttttccctgaaccaagagtctccaggtgtcaacacagaagtagctgttcacaattgttcaaagttacctagggcatgatgggccttggtcttcttcctcttcttggtcctttttaattcctacaataaattcagacagggacagacaaaataagccaattcacctacacccataacagtccactgtctaatccccacatgaggacttcaggctcctcagcatgagaacaggacaatgagagagatatacttcaggaggcctgaaagcaggtcatgatagagattctttagttgcatctcagaaccaagggtgaaataccactattctggtagatcgttatcctaaaatcatttatcccaagattgtggaaacagttatgccttattgttcccatcaattcaaagaaaatgccccagatgatttctaggaggaagactgcagtattcagccctgtctcctcaaatgcccagctcgttcatggttgcaagatactgaaactagaatgaaggaggaaatctacaaacccttgagtccaaataatagttctgtgaatttttcacatctgcctgggtccaatgtgctgagagtgggctgaggtggtcacaggcatggctggagactaggaatagagccatgctcactgacccatttcatgtctgggcttccaactgaaactacagtctcattacaagctatatgcacccacaggtcctgcctgtggcaatgacacctctcgggtcagtaagggccacttggaacaggaatatcacccctatctggaagaccaggtggaggcttatcactttcatagtaaggtactcactatccacatcaagagccaagccaaggtgctgttcctccaatgagtaaaaggcacttatgtagagctggcatgagtcagacagttcaagataaccagaaggagttgaataacatctatccagtgagtcccgcaagacttcaggctccttcttgtccagcagctccctgctgagcctggaaaagtaggaaaaagtaaagaataaggcaggggaaatcagaaaccacacagccccagctagatttcatgggtaacataaggaagtgttttaaaagaaaaagaacggatccagtaatgaggtaacaaattattgcctttatgttgggatagaccagggtcaggtataaacggatgaaagaggaagagagagacacacacacacgcacacacatgcacacacacacgcacacacagagacagagagatagtgagctcagtgaattggccaggtgacacactgatgagggaatcaaaggacactctgtatttgtgctgtcaggacacacagcaaacagtgatcatgaaaagagtggtcttaataactttgcacaaaatgtgctcaagtttccctgcagtcactatgagaatacagcttttgaggtatggtcaaccttcactaggttagtaaatgataaggtaggaagaaatgaaaacctaaacatttaatgtaatgagaaccaaaagcaatgttagtaggcataattcagacttgtctgacaagatgaaatcattattttcagcatgtactcttttccctggacttggcgtctccaggtgtcaacaccaaattaactgtccacaatttctcagactcatctgggatctgttgcctcttggtcctcctttttcacttgatcacatcgatgtcctgcatgcaaataaattcaaatggggcctcttacattaagcagttcttccttgcacacagaaaccttcctctgtccaatccgaacacagggacatcagtcttctcagtgtgagaacaggagactttgagagaagtataccaggaggcctgaggttaagtcttgagagaactgacttggttcctttcttgagctttcggcaaaattcccctgttttggaacgttatcttcccaatatgctctgtcctaggtttgtgtacacaaatgagcaatatttctcccaatagagtttaagcaaatagttctaacaccttgtaggagagatactgcaatattcaggcttctctcataaaatacccaggatttgatagcttacgagattgtggacactgagatttgatggaggggtgcaatgtaccagctcttgagtcaaaatgagacttggttcgacacggaagcatcagctactatggcttttttgggtaaaaagtcagccatttatctagaaaacatgccagcaagatgatggacagatgagctaaaacaagccaacttagaagacacagaaaatggggataaattcagtgaaacctgggtcacattttccactgagaggtagacaagggtaatactggccttaggcaggtaaagaactgcacagacatgctttgggaacaaaactcataacgaacttcgtagctggcaagagacatttaattcagatgagctgatctgacagacaactcctgggcatgtgctgcatagcttggtgtgagtttgccacaccagccttgagttcaatgtcctgacagttgaaccagcgtgccacgggcatggcctgagactaggagaaagccaagctcactgacccaccccatgcctgtgcttcagactcgactccagagtgattgaaatctacattgatatataggttcagcccacagtgatggcaactctcagcccaaccaggggcacaaggcccggagattatggggtctacctgggacacgaacgggagctttatcaccttcacaatggagtattcactgcctatgacaagagccaagccgacttgctgttcctctaatgagtgaaaggtgctcctgtaagactggtacgaggctgacttgtcaggaggaattgagagagtcgaataaccttcatcccaggactcctgaggggcttcctcctcttcagactcctgcagattcctgacgaggcaggcaggacagggatgacagaagatttaaccaacagagattagacaacaaaacctcccagatgttctgatgggagacagaatggagtggtcacagaaaccaaaggcatttttccttcaagagaaataaaattatccttctaaatgcaaggtagagggtgtctgctctggggacagagcaaaaatgggcagcacgtgctcagtacatttgccacagatgagccaatgtagggcaccaagactctccctgtaaactaccatcatgacttgcagcacagagaactaacactgggcttcaactactttgcataaattaaattgaattttacatgcagcattcaagtgaacagagctcttgaggcagtgcagacacagatcttgggtattaagggccccatttttccaatattttgatataatacgtttattttttcaatttcttttcttgcacaaatactagcaaacatactaacaaaaaatgggcagaaagcatatatacatctctccctggatttaaacacatgggagagaacaggcaacaccaagaaatccctgtttgagggtctagagtagactcccaggaaactccaacagacctgcagctgagggacctgactgttagaaggaaaactaacaaacagaaaggaatagtatcaacatcaacaaaaagaacacccacaccaaaaccccatctgtaggtcaccatcatcaaagaccaaaggtagataaaatgacaaagatctggagaaaccagagcagaaaagctgaaaattctaaaaaccagagcgccacttctcctccaaaggattgcagctccttgccagcaatggaacaaagcaggatggagaatgactttgactagtgacagaagtaggattcaaaaagtcagtaataacaaacctctctgagctaaaggaggatgtgcgaacgcattgcaaggtagttaaaaccttgaaaaaaaaattagacagatggctaactagaataaactgtgtagagaagaccttaaatgacttgatggagctggtcatcaaaccatagcatgagaactacgtgatgcatgcacaggatcggtagccaattcgatgaagtggaagaaagggcatcagtgattgaagatcaaattaatgaaatgaaatgagaagagaattttagagaaaaaaagagtaaaaagaaatgaacaaaacctccaagaaatatgggactatgtgaaaagaccaaatctatgtttgattggtatacctgaaagtgacagggagaatggaaccaagctggaaaacacttttcaggatattatccaggagaacttctccaacctagcaaggcaggccaacattcaaattcaggaaaaacagagaaaaccacaaagatactcctcgagaaaagcaactccaagacacataattgtcagattcaccaaagttgaaatgaaggaaaaaatgttaagggcagccagagagaaaggtcgggttacccacaaaggaagcccatcagactaacagcagatctcttggcagaaaccctacaagctagaagagagtaagaggccaatattcaacattcttaaagaaaagaattttcaacccagaatttcatatccagccaaaggaagcttcataagtgaaggagaaataaaatcctttacagacaagcaaatgctgagagattttgtcaccaccaggcctgccttacaagagctcctgaaggaagtactaaacatggaaaagaacaaccagtaccagccactgcaaaaacatgacaaattgtaaagaccatcaatgctaggaagaaagtgcatcaactaacaggcaaaataaccagctaacatcaaaatgacaggatcagattcacacataacaatattaacctgaaatgtaaatgggctaaatgccccaattaaaaaacacagactggcaaattggataaagagtcaagacccatcagtgtgctgtattcaggagacccatcgcatgtgcaaagacacacataggctgaaaataaaaggatggaggaagatctaccaagcaaatagaaagcaaagaaaagcaggggttgcaatcctagtctctgataaaacagactttaaaccaacaaagatcaaaagagacaaagaaggccattacataatggcaaagggatcaattcaacaagaagagctaactatcctaaatacatatgtacccaatacaggagcacccagattcataaagcgagttcttagagacctaaaaagagacttagactcccatacaatcataatgggagactttaacaccccactgtcaatattagacagatcaatgagacagaagcttaaaaaagatatccaggacttgaactcagctccgcaccaagcagacctaattgacacctacagaattctccaccccacatcaacagaatatacattcttctcagcacaacatcacacttattccaaaattgaccacatagatggaagtaaagcactcttcagcaaatgtaaaagaatagaaatcataacaaactgtctctcagaccacagtgcaatcaaattagaactcaggattaagaaactcactcaaaactgtgcaactacatggaaactgaacaatcagctcctgaatgactactgggtaaataacgaaatgaaggtggaaacaaagatgttctttgaaaccaatgagaacaaagacacaacgtatcagaatctctgggacacatttaaagcagtgtgtagagggaaatgtatcgcactaaatgcccataagagaaagcaggaaagatctaaaatcgacaccctaacatcacaattaaaagaactagagaagcaagggcaaacaaattcaaaaactagcagaagacaagaaataactaagatcagagcagaactgaaggtgatagaggcacaaaaaacccttcaaaaaaatcagtgaatccaggagcttgttttgtgaaaagatcagcaagaaattcctgtttagctagttcacctggctcatctgattgcaagttcctatcttgacaggactacaaaattaaaaccaatacaagggccacaaataatgcacaacattgttaataaggacaatttgtagttgggtgaaaagaagaaatagttctatacatcacttcccctttttccctaaatctacaatctcctggtgtcactattgaattaacagcccacaattccatagcattacctgggaaacactggccctttttcttcctcttcctcttcctcatcatcactttcattttctgtaaataaattcagagaagcaggtcacattaagcaattcacacttcacatatgaccaaatcagtgttcagtcatagcacaaggacataactattctcagtgcaagaatatggattctgataggaatattctagggtgccctagattaagtctgatgagaagtagatgaccctgctttccagacccacaggccaaaatctccctctatgagtagaccataatgccatattccctgcctgagtctatgcaaagttaaacaaaatttttcccaaaaaaatctccaaaaattgctcaaacaattttctaggagtgttgctgcaatactgacttatatccccaggtaacacggacattaaatgtttagaggcatctatacatgaaacttgactgatagataaatttgaacagctcttgctttaaaaaggatctgtgatttgggaggctgaggcaggtgaatcatttgaggtcatgagttcaagaccagcctggccaatatgggaaaaccccatctctactaaaaatacaaaaactagccatatgtggtggtgtgcacctgcggtcccagctactcaggaggctgaggcaggagaatcacttgaatctgggaggcggagtttgcaccaagccaagatggtgccactgcactccagcctgggtgacagagtaagactccaacgcaaaaaaaaaaaaaaaaataataataataataataatctatgatgctacaaagaaacattggatcagccattgcattgatggggtggagaaccagggtccagccttgctttatggaaatatatcagcaaagtaaagaagaaagtttccttcccgatttcaaggtgactgtgcaaagtagctaggtaagctgacttaaaggagatcgagattaaagctgagagcagtgaagcctggggaacaatatttccaaatacacaggaaaagctgccagcttcctttaaaaggcatagaaactccatggacattgtttagggacagatggcctaatcacaggggacaagagatactgagtcaaagctaggaggcctgacagatacttcctgtgcacctcctgcactcaggtgactatgagattgtcacacttgcttggggtccagtaacttgatactggggactggcagacaaaggcatgacatgagatgagaaggacacacaaactccctgatatctgtgtttagaatccaatcgtagttttttattcaaaccaatttgtgtatatagagcctgtcttcagagtttatcttcctcagcctagaaagaggtatgagacacaaggaaaatagaggctacctgggataatgtgtacagcatcctctcattcatcatgagaggatgagtcaatgagagttggatcgactttatcttcctcaaatgtgattttggtgttcctgtgaggctggttggagtcacaagggccgtggctatttgaacaagtgacggcacgttcctccagtgagtcctcagggacttccttttcttcagccttctgcacctccctgatgagccaggtgggatcgagatgacagaagattaaacacagagagattggaccccagggagtcctagctggttttgacaggaggcatgagagtggtcccagaaagcaaccaggaggttccctttaagagggaacaggcaatcctcttctctctgcaagagaacatggccgccaaaggagccagagaggaagagagcagctggtgttcattgcactggacagataggagctgaggtggatgaagactcagctatccctgtatggtacagacatgacacttggcacacatagagaaacacgacagatgccacactctgtgtctcagctgggttgaatttcacatactgtggccaagggaatgcaggcttttggcccactgtagatgccagagagggtgtgccttttaaacctttttcatgtgttaccacccattacttactcctgagtattcagtgttacctgggggcacatgattcctgtactttctcagcctcctcaacttcaacatctttatcctcatcttcatcattttctgtaaatacagaagtgtttgttcagctatttcccacttcacactctgcaagacagtcagcccaatgtacacagagacatgaacatctagtcatgggttaccgttaaactgaaagctctcatgttttgtctttaacaaaatgccctggaacggttttctgatccatcaggcaatgcatttctgatctggagggccaccatcaagatgtggccaaatactgaaaagactttttgctccccatatcactggaggcttgtgcagcctctctctggactttggcaactgtctcccccatcccatcacagatctgattcccaggcacaggcttggtgtcttgtcacagttcgcattttgaacctaattctttctcttaggagaggacaagcttgtcccacagtgctctatgaatcaggagacttcacaggccctccatgtggcttctgctgtgtgacattctctccatggggagtgctccagtctgaagcacttcttaccaccaaaagcccctacatcaagtgccttctccaacatgacaaggcgaggagcttcatctcattttgaaaagcagtagtaagtgttcccacatttggatacttcagtcccttgcaagaaacaatctgtctgcctttgcagatggtgagagacaaactcaggaaggataaatcactcacttaccgacagttactaagaacattgctgaagaaacagcatgggaaccttcattcttagtccagagctcttttcactctaacaagcgccctccagtcacagcctccttcctgtcctttaaaactagacagatgctgcctcttgctccaaagatcaccttccatcaaggaagaagggacacttgcaatactgtgacctccaaccccatgggtttcccatctctgttcttacccaggaagtcctggtcatgtcatggccacatatgtttagtggaaaaaaacaccaccgatacaactgtcattgaaagtatggaggtctggagtctctcataagcctggggttttgggtcatcagggcctacggtcaccttacctgggctgagcttttggacaaggtgctgtgccagcctacacccctcagccagctgttcttggaggtcctgcccctaggacttgtcccactcatccagagtgaggagggcctggagatgctgattcaatgagtgggaggcatctctcccttcctgtaacttctcctgtaactgggtcagctctcattcctgagagtggactgggactttatatcacctaaggttagatagtagagaaaatttaacagtggaactggatgagtgatcagttctaatattatgacagatttctgagagaatgtcctcaaggagacctccacgcagaaggtcaacatacgtttaaagaaatgtctgtggccaagaaaaagaataaaaaatggtttacaggcttcctctatatcagagagggctcctgtaagatcctcgatgatgttccattcatctttctcttctgtaaacaaaagtaggtgtcttcctaattcagtttcaaaacaacatcccttcagttcctcactctgaccagggaaatctccatgtgaaaatacacatagtgcatcttgcggcgactagatacaaagccatgtacagaaatgaggccaggtgaagatggggagaattgaaaagacaaaagaagtaaagaatgacagggtcgagaaggcaacattgattgagtgaaagaatgagaagcagcagtcaggaggtgattctcacttagggtaagtagggaggtgatggcacaccattttgagtatactgaatgctgctgggttgttcccactcctttggttaattttgtgttattcaaatttcacctcaacaattacttgtttgaaaaagagaaaacaaggctctgagaaacaactgcaacccataatttattattatccttgttctctgtttgataaatatttgtgtgtcaagagccctaccatggcaattcctgcctttcccctggcccagcttagctcttacttctccccaccgagctgctgtacttcagagcctgcctgccccatggggcctgcctgcccccacttgcctgcccccacggggacccctcacctgagctcctcagcttgcctgagctgctctgcaagcttctccttgaactgcagctcattcctcagcaaagattttatgaggtctttgcactcttcacactctgagaaaagacagacacgcctgcctcagtggaaggctggacatgctgctgtggtcactgcccacagggcaggagccaggtccatcccaaggacaaaactgtccccagtaccaggccctaggaagggatttccacatctttattcttcagtctcctgactttctggcatctgatcctccaaaatttagggacgaagaaagagaaactcaagggcacatcaagaaagttgacaagatgattcaaccacaatgaagtggagtcagaattcacagcccctgaggtttgactctgaatgcggggccactttcccaagccttgcagcctctcctctaaaacactgcactggggcatgaagtagtgatttcttgtacagtcaggaaggccccccaggactatgggaatgatggtttcccttttactgggaatttcaaggacaaatatgtcaaagatttttaaatcatatcttcagatatgattttaagaatcatatctgaagcataaagtatgaggcataagaccataaggccatgaagggaatacgcccaaatgctaataaagtttgtgttaatttagaaacagtagaatgaagaagtaattgatagtgtttactctgtgccaataaatgttctaggagattggcaagaaatagctcatgtaattcattgcagcaatttacagaggtaggtattattgtcgtaccctgtgaacagatgaggaaactgaggaacagactgagggacagacaagacaagtaacttggatagagcccaggagacaggcctagggtccctgctctgcacgctgtacttctacttccacacattctcaggtgcgacctttcttcttctttgggagcaagagcctgtgcctcaggaagaaggacttccctctcaacagggtactctctacttttttttaattaattatttatttatttatttatttatttatttatttatttatttcgacgagtcttgccttgtcacccaggctcaagtgcaatggcgtgatcttggctcattgcaacctctgcctcctaggttcaaagaattctcctgcctcagcctcccgagtagcggggattacaggcgccgcaaccacgcccagctaatttttgaatttttagtagagacggggtttctccaacttgcctaggctagtctcaaactcctgacctcgtgatctgcccaagtcagcctccgaaagtgctgggattacaggagtgagccacagtgcatggcccctactccctgctcttgatgctgtcacttatatataccacatgttctattaggagcagactgctcttgaagcccttcagagcgggtactgggtactatcaccaagtttccctcagggtcactagaacagagctttgcctattgggcctcaacagaagcttgaactgaataaaagttcacttgtccagacatttagaacaacagactagatgttatttgtctgcaggatcttatatagtacagagaggattcttgaaaacatgatttagcctcttggagaaaacaggtcattctgtgcctgtgtcagaaatcaataactgggattttaactctagtcccacccccagctgactgctaacatggaaagttgctaaatactttggtacctctgtcttccaaatttaacaaaatgttaaaatacccatttctattttcttagatgtacgggaaggatgaaattatttttgttggagacagcatttagtttctcagagagaagatagggcattattcatcacttttgtgatggtgagcctatagaacttatggtatttgttctgccggttggccaggagtaggccacttgagttacaagaaatttctctttgatgattctgaactgctgtttgttctctgccagctgggggcgcaatttctcattgatttctagaatgttcttttctgccttctcactggatcaagggctggcagacaacaccatgctgacgtttgtggcagaagaggtggagccagggactggggagaagaaacccaaacacatgatgggttaaaaactggtgaaatccaataggtttaatcaggactgagggatgtcagtaactgaaattcttaacttactattgagaaaaatgtgatcactccccacagcactttaggatccttcaccacaaaaacaaggtttgaggtgcctgaactcagagctgaaggcactcactaccagtagctcagactctgacaaaagtaaggaagattgtggccagcgtgccaggtaaccgtctgcagttgcaataacagaattagaagataggggtgtcatggaatcttaggagctctgcgttgcaattgcccaggctttgctgaaactcaggcaccctggtctcacctgagggtcaccaccaatgaagattattccttcagcattcactctcagtattcgtgtacccctgtgacaatgccacagacccatctctttcccaatacatctaagcatattcctcactgtttatctcttgtctgtacaacatcatcaaggcaaacagtttcccaacaggttatattttcttaatcgtagtcatgaagtcaccccacctgctctaagttaaaacagaacttaaggcttttccacaagtctaaggtatcaaacttttagcttgccctgatgtcctctgggtcttctgcagttttttctgtatccactagaaagtgaatgaataatccattttttaaaaatgttttctttcctgtctcggtattcttcttgctgcatcccattgttatgttgattcctttttttcttactggggcaccatcttggcttttcattacactctagacaagtatgacatccctacatccaaaactcttcctctgtgtggggtgatttgttttttaatgtcactgaacactacattttatacttgtcacttatggatgtcattctagtgctacaagagctcttttcaaggtatcaagtgatcaaaatcatttacatagggatctcctgaaaacatgtgtgaccatctatcttgggaatttttgtaaactgatgctattttgttgtttccattttgttttcccatatactgaaaagaacaggaccacgagcagttcttatggaatatggtttgatatattttgttgagttggactaataccattgatttttggttgcattccactaacagaacatgacaagatcaaggttatggtcagggttgcttgctgatcctcactgttgctgtgcagtagaaggtgagtttgaggtgaaaggcgtgagtaggaaagagtgatcccctgaaccacctcctcactttctcagctttcatcccacctaggttttgtgagcctggaacttgggagaatgttctgtagcccaggtctcctaagattggctgctagacttgcctgagttgaggatgcagtgggtgtgaacctgggctgcccagcattcatgtggaagtgaaggaaggaggactggatcaatcccatttgaaagcatccctccctgcagcccgcaccatcctccaatgacactatgaggacactgctttgagatgtatcaaaggctttaagtcaatgtattttctggggtctgggagacctgacattctgtttcagaatgaaaatctgtcaggtttattcattttacaaatgataaaactgcaagttcacaaagttacatggcttacatgaggtcacacaaagatgagttttcagcactgccaataaaagcaatcacaataattattcagtaattattcatagaatccatataattcgtaaacattcacataattatttagtaattattcattgaccaattcatacaaggcattttgctcaaaactgtgctcatatttggacattgtatcttcatcataatccttaaggtaacgctattatccgtaagtaacaggtaagaaacctgaagaagaggaatagcaaatcatgtatttggccatatttccattttttggtttttgtgatgctggaagaatgaccagaatgagtcacgggaagaatattcattcctgtattattctccaggacagaggtgtgctctcctagagtactggggccaaaattcagaagtgtccgcaaccttgctttaacagtatgggaaataacctctatcacctggaatttccctggaactttggaatatacaagagaagtatgagatttgggtcttcctttggctgtgtttaattcactcttctatggaataccaatgattctcactaagacttctgcctttttataaccacaatgtatgttatggagaagattttatactttgctctatttagaaagaataaatatgagcaatggtttaggttttaggtcctggacttaatatttttctgatttctgttttgagattaaattctcatgtaaatagaaaaatacttattatttcttataaggccaagtttgttattagtttgagttttcaaaaatgaagcacaaacttttgattttatctttgtctgtccccatcagcgccactcattgtctatcagtatgacctggacttgcccctgcacttaacctcatcctgctgagccatctccaagcactgtccaattccgtcagtgattctggctcctcccaaggctccctgaaatggatgcagggatcaggacatcagacacattccagacacaaaggcaacccagactgtagagcaggcagctgtgttcccactaccctaatgttccagtgatgtcctaaaactgaaaggaacactttccctttttaggggtctgttcttcatgtctcaatgcctctggtctagttaacacaactgttctgtaagtgaaagaacttgctaaatttctggtttcttgttaggtggctagaataggtttataagacttccttacttacccatgactgctgaagtttgaattcttaacagtatgattctttttcttgtaagatgagcagtttaggaaagataggccatgttgctgtgcaaaaagaggtaaacttaatttctactcaaagcatgcttgaatttgaagctagggcttccattcttccaaagttggactgtcactgcctcaggcatgtgttccgaagggcttgtgtctctgctgtactcaaaataaagtttaaatggagcccagcaagccagatctcctttagttctaggttcccacaacagtttctcctctgctttagagactgcattgaaaatattcttgttctgctgttgtgttttggctttggaatgatgtgatgcagctcagtgggtcctacccccaagttgatcagagtaagaaacacctgggaaagtcagtgcaaatacaagttcattgtcctccttgcagggatttggaatcagagggctcaggtgaggcctggaatgtgtctgttaacatgactcagatgtgcagtcaatttggggacccactgatagcatcgaccttacagtttatgggatgattctttctgttttgctgatgaaaaaactgaggcacagagagtctgtaactttcccaagttccccttgctgtaagtcctggagccagatatcaggtggagcagcctcttccccatcaccttcccacattttcagctgggtcagttctttccaagtacgtgtttctctcccctatacctcatttctgaaaaaaggaaaacttctagaatgtaacttctttcatctaatacatttcctcaaaacttgctgccagcatcatattctggccacttattattaaagtgagatgccttttttttttttttttttttttttgagacagggtcttgctctgtcgtccaggttggagttggtgattatagatcactgcaacctcgaactcctgggctcaagcgatcctcctgcctcagctttccaagtagttggaactctaggcacacatcaccatttctggctaattttttatttttcatagagacaaggtcttgctatgttgctcaggctggttttgaacttctggcctcaagtgatcctcccacctaggcctccaaaagtgctgggattacaggagtgagtcaccaagcctggcccctgaaatgcttttttttttaatttttttttttaatgaaaatacaggacatggagatgtggaaagacaccttgctttattactgttgttattattattatttctacagtataattcatatatcacaaaattcaccatttttaagcatacatttcagtgtcttttaccatatttcaaagtctcacaaccatcaccactacctaattccagaatattttcataatgccaaaagcatgcctgtatgggcagtcactctccaattccccccttcttgcggtctcagacaaccactaatctactttttcaatatacagatgcacttgttctgggcacttcttctatatggaataacaaagtgtggcattttgcatctggttcttagcatattgttctcaagtttttttagcctgcattagtactttaacttttttatggccaaataatattccactatatggttatacgacattttgtttattcatcaactgatagtgctttaagatgtttccactttttaactcttatgaataatgctgccatcaacacctttgtacatgtttttgagggaacacctgtttttcattttcttggttgtaaacctaggagtgcaattgctacatcatatgtcactttatgtttaacttattttatgtttaactttttgaggaactcacacactgtttaccaacttcagtagctatgccattttacattcccaatagtaacatatgagaattccatattctccataactttccaaacatgtgttttctttatttttttcctaagtcatactagtaggtgtgaagtggtatctcattttggtttaaaattacattttcctaatgaaaaacgttgaacatctttgcacgtgcttcttggccatttgtgtgtttcctttagagaaacctctactcacagcttttttcccattgttaaatttggttgtcatttattgctcagttatatgaatttcttatatactctaggtactagacccgtgttaaatacataatttggaaatagttctcccattctgtggattatcttttcacttccttgacagtgtcctttgaagcatataagatttttattttaatgaagtccattcatctatttttgggttgtttgtgcctacttaaaaaatgtctaatccaaagtcacaaagatttgtacctatgttttcttacaagacatcatttttagaatgagaaatttccttggttttagtggagggcagacattgtttatgcctcctgtccattaccgatgtttctcctgattgttattcatatgctcaccacccctccatggagcatcccacggcctgtaacagagctctggggactgatatccttccactgactttggagctggtgagagccctggtcatgtgattcagcttagccttaacccgacccagttgcacatattcctcagggccttcagagttgaagtcgagaggctctctgagaacgcttgccagcccatgctgttttaaggctggagcaaacttcctccatctattccagacagaggggactgcaggggtaggagtcagtcaagacatctctggtgttagaaagtagagctgtttcagggtttggggaagattgttcaattaaactaagtcctctttgtttttactgtatgtgtgacttctttctacaaacaaaggaagaatatttatgttagaacattttatctattctttatcaattgtttgtctacaattttaacgtggataaaggagagctcagtgtaaatatattcttaaaaactaattatggttcatgtccactaccatgcgatcatatttaaatctatgaactatcctgttacttaggtattatcctgctcctgatgagaaaacaaactcagaaagattgcaaaatttccctaggtcacaaaaccagtgaggagaggaataagaattagaaaccagttccttttggccttcaaagctaaccatataccattagatcaaactgatttacatacttttgctggaattagtctcagagttcatggttctcgcttgattttcccaaggaaactgtgccactttaatatcatttcaaactttgaaatttaaactcttttttattatacttttttgtctttgttctgttccatttcttttgatttcttctcaacgaatccctcttatttatatgctaaatatttgttacctattttctgtcaattttcacatttttgagtgtttgttttctctctgttgtatgctaacagttcttcattgagatacaatttgcatagagaatactgcaaaaaacctaaaggtacagctttataaattttaatataattatacattgtataataacacccagttaaagacagagaacattttcccccatgccacaaggctcttatgtggtccttgccagtcaatactcatcccccaaatgaagaatatattctgaatgttgtcactgccttagtccctttgtgttgctggaaaggaacaccagtggctgggtaatttataaagaaaagaggtacatttttcccatggctctacaggctgcacaagaagcatggaacctgcatctgctcctgatgagggcctgaggctgcttccacttgcagcaggtgaaaaggaaccagtgtgtgcagagatcatatggtgagagaggaagcaaaagaaagtgaataaggtgagaggcactttttaataaccagctcctacaggaactaagagagtgagaattcactcactaccttctcccagggtggggattaatctattcatgagggatccactcccgtgacctaaacacctcccattaacccccacctccaacactggggaccacatttaaacatgtgatttggaagggaccaatatttaaactatagaagccgccagagattaattttgcttattcatgtgcttcatgaaaatgaatcattttggccagtcctggtggttcacgcctgtaatcccaagactgcgaggctgaggcgggcggatcacctgaggtcaggagttcaagaccagcatggccaacatggcaaaaccctgtctctactgaaaatacaaaaattagccaggcgtggtggcaggtatctttaatccctgctacttgggaggctgaggcagggaaagtttgttgaacctgggaggcggagccaagatcgtgacactgcactccagcctgggggacagagtgagactccatctcaaaaaaattaaaaaatggaatcgttgagtatgttctcttgttctgacttctcttactcaggtggttttgtatgccactagtttgtttgattgtgtttttccctcgtttcattttgttttggccaagtaatatcctattgattgtatgattgtcacacaatttgatatccatttttctgatgggagacaggtttacttgttggctgctgtgcataagtaactatgaatattctcatacaattatttctgtgaagatacatacttattttccagggtatctatagctagggatagagttgcttggtgaatgtgtagaaaatgggcacagagttttgcaaagtaattgtattattttacatttctatgaaagatgtaggccatttcccattgctctacattcccacacacttaatattttcagccttttatatatagccattctacaattgtgtagtgatatcctgttttggttttctcaggcctaatgttcatttagatatcttcttatggaaaatatcttctcaaatttttatgttcgttgatatactggggtgtttgtcattttctttgtaatctatagccattctttatatattttgaatgagtccatttatatatacatttttttttttttgctatattacattgcaaataattattcctggtctacagatagcttttaagttgttaatcaacaacataataagtagaaggtttttaaaaatgaagtgcaattcacttgatttcttattgtggtgagtgctacagtatctagtctaagaaatattttcctatgtcaagttcatgaaactatttcctatttttcctttacaggatttctaattttaactttcacatcttaagttaatttcaatgtatgatggagaatggttgttaatattaactttttaaaacaacaaatattatttcactcaaaaccattttacttaaaagtctttcatttccccaatgaaaggcattggtgtctttgtttttaaaacatttagaagtggcagtgcgagcatgttctcactcatgagtgggaattgaacaatgagaacactcggacacagggcggggaacatcacacaccagggcctgtcatgggatgtggggctgggggagggatagcattaggagaaatacttaatgtaaatgatgagttaatgggtgcagcaaactaacatggcaaatgtacacctatgtaacaaacctgcacgttgtgcacatgtaccctagaacttaaagtataataaataaatgaataaatatatatatttttttaaaagagtggcagtgcgagggctgctgcacagctagcagagccgtggtgaggacggcagcgcctgtcccgagctctccgcctcccctgcccgccagcccaggcggccccagcagcagtgaccagaggagcccctgcagcaacgcaatggccaggtggatgcctccatctacagccctgtggcggatgggacctgttaggacatcaccatcatgggcaacaaggacttgaactgggctgccatctcagggaaaaccttcgccaacatcaccccagctgaggttggtgtcctgtttggcaaagacttgtcaagctttttcgtgaatgggctgacacttgggggccagaaatatactgttgtcccggactcactgctgcaggatggggaattgaccgtggatcatcatatgaagagcatcagtggagccccaccttcagtgtcactatcaccatgactgccaagacgccaggcctgctgatgggcaaagaaggagtccacggtagtttcaccatttcataacaaaggaatgttatgaaatggcctcccaccttcagcgttcccaatactgacctcctttgttccttcccctccactgcttcccacagctttgccccactttccttctcatacatacaccattttaatttcagggaccattactccacacaccttattgctgccaaaacaacatgggctgggggccagggatagatggacagacaccttcccctacctatacccctcttgtgtgtggttggaaaacttttttcttttgaggaattttttaggaataaaaaagattctactaaaaaaataaataactatacatatgtttgaatgtatagtttgaatctgtattcttttcctttgatatatttatgaatacttacaacagtactaccatttttaaattactttaaaatcaggtttgaaatctagcagagaaagtgctccaacatattgcttctttaagaccaacttgcctattataggttctttgattttcaaatacattttgaaattagcttttaaatttctctaaaatctcctactagaaatattaatcagaattgtgttgatgtaatatgctaacaaaattgagtcttccaatcaatgaacatgatatccatttctctatttagtcttctttaatttttctaaccaattgcttttaggggccttgtgcctgcttcattgcatgtattcttaagcatggaatgattccggctattaatctctattatgttttattgaatttcattttctagctgctaattgctagtatggagaaattaagatgatgaaatcaactttataaaggtttaatttaggtacaacagactgcaccactttaaaatgcataattcaatgcatgtttacaaacgtatacactaatggaactactgccacaaccaagatagaggaatttatgccccaaagtttcttgtacccctttgcagttcatcagtctttcaaccctcgtgcccaaggaaccgctgtcacttcaggtccgtttccatttttaaccattttctataaatgaaataatacctgcgttcttttgtatctgccttctttcatgcatcaacgtaattttaaaatccatccagatgagtattttcatcaatagttaatgccttgtaattgctgagtagtattccttcatgtggctataccatgtatgtttgtactttcacttgttattggacatttctatcattccatgtttgggctattatgaagaaactatcatgagcatccatacgtggcaggccaggtctcactaacacaggcctccctaacaattatttccgtaccgactgagtggttcagttaaatattaagaggaaggagaaaaaaaaaccagtgcccttatacaaaggctggaatgtaacaaaagcccaccaagagttttgcctaggcttttcctggaccttaaagcatgacaaaataatgagggcattcttaacaggagtcgtttagtatgaaacaagttttattgggggtctgaagaaactccccaggcctccagaaacaagtttattggaggtctgaagaaactccccaaacctctgtgatttagcaggagacaagataagggtccccagcacctagacccatttagattaagtgaatttactgaggctccagaggaaggtcttcaggactcagaccttagttatagattaaaataggttaatcacttatgtatttacaggaatgcacacttccacatgcacatatagcttagaaggtatataagctcaggaaaactttgtaattttgagttggtctggtgataatttccaggccttttccctgtaaccagttgcagaagtaaaaattctcttcctccccagttcatcagcatcttgttactgacacacaagaaatagcagcccgcccctcagtttggtctggaaacagacatacagatcattgtgcagacacagcgtgtaaattcctaggaatggaatgactgtccatctcattggtacatgtttaacctttaagaaactgttagattttcagtcataccatttttcattcttacaagtataaaacttccaagtgctttaatcctcaccaatatgtgctattttcagcatttttaattttagccattctcatggatatgtactggtatctcattgttgtattgattgatctccctgatgactaaacagtagagcatctttttctatgttaattgaccattcatgtatcttcttttctgaagtatctattcaagtcttttgagaaattatttcattgtgctgtttatcttatcagactgcaatatatatagtatatatgtatagcatatatatactatatatatagtgtatatatatagtatatatatagtgtatatatagtatatatatagtgtatatatatagtatatatatagtgtatatatatagtatatatatatagtgtatatatagtatatatatagtgtatatatagtatatatatagtgtatatatatagtatatatatagtgtatatatatagtatatatatagtgtatatatatagtaaatatatgtgtgtgtgtatattatatatatacacttttaaaaaacctttgttggagatatatatatctcctatattgtggcttctttttatgttctcttaatgttccctattaggagaacaatagataatcttcaaaaaggtgaatatatatatatatacacacacatatatgtgtgagtgtgtgtgggtgggtgggtgggtatgtacacatatatatatgtcctaagaatcattaattagacatatatgtgagtatctatttctggattctctcttctcttccactggtatatattgtattttttttttcaacaaaacacatgatcttgattttcatagctgtagagtaattctggaaataggtagtgaattcattcaccattattcttttataatattgctcttttattactcttgatcattgacattaccatataaatgctagaatcagcttgtaaatttctaccaaaatgctgcttggaatttttactagaattgcattggatctggagatcaattcatgaagaactgactttttaaacataacaactcttctgatccatgacaaggcttatctccccactaatttagttctttcataatttctcaaagcaatttttttgtagtttttggtgtactggccttacatagattttgttgactttcttttttcttttttttttttttgagacagaatctcactctgttacccaagctggagtgcagtgatgtgatcttggttcactgtaacctctgtctcccaggttcaagtgatcctcctacctcagcctcccaagtagctgggactacaggcacatgccaccatgcccagctaattttttgtagttttagtagagacagggtttcactgtgttaggcatgatggtctcaatctcctgacctcatgatctgcccacctcggcttcccaaagtgctgagattacaggtgtgagccaccacacccagcctgttgaatttatttataaccacaacatgtatttagatgttactttaaatgaaattgtatttttatttcattttccaaatgctcactgctaatatacagaaatacaaaagactacttatattgagcttatattttgcaacactaccaaactcactaattagttttggtagatttttgtagatttctaggattgttaacacatatagacattatccgtgaataaagacagcttcaattctttattttcaaccttttcaatacttttatttatttttcttactttattgcattgatttagagctctagtataatgctgaattgaaagagtaacaacagatattctacttttttctctgatttaatggaaaagcattcaatcttatgccatttaatataatgttacctgtgggtttttcaaatctgcccttaatggggttggaagtgttgccttccgttcttatcatgctgagagttttctggggtttgtttttataaatcatgaaaaaagttttcaattttgccaaatgcttttactgtgtatgatgaggcaatcatacagtttttctcttttgccctgataatatataaaattatactttttaaatataaaaaagatttcttgaatcaagctaggacagtttttttaattataaacttttaacaaatatattgaaatataacttacatgcaattgagatgcattaaagtgtgtaatcactaaagtgtataattaaagtgtataattttaagagtttgagcacagtatgcatgagccaaagagaaaggacagaaaatactaagtatgtctcagcatatgtggtctatcttggtgaatgttctatgtgagtttgagaagagttatttgttagctgttcttagatgtattttgcttaaatgtcgacttggctaacttgtgtcattgattgtgtgaattaattttgttctagtgggcattaaaattactgtctgatcacattggacttatgtggacttggtttatgttttattacagtggattcatggaaagccaacagcatttcccaagactctctaatttggtaggactcaatcaccaatccacccctttgtggatggtgtcagggtttcgttttagcctttactagggctggtctagaataggccttattgtaaagggtgacacttattcctaaagcacagcctttccagtgtctcaattggatacctggatgctaatgaggtgtgcatgagttcttcccaccctggatggcaggaactccatcatccattccccaaccctcttccaccacaagtacttctggtccaaactcaactttatagcagccactcctatgttaaatctgttagtctttttcttgtgcaggtacagtccattccttgataagtatgcacatggaaccccacatggacttcgagagctgcccctctgaacagctgtctcctattggtgccctgccctgcagattggaatttcttcagtgaccttgaactctgatctctgccttctcagctcagtggggatgccctgctctgagaggactctagcctactgtgcagctgctgagaaattctccccagacaaaaactaggaaatcatggggcttccaccttaagtttcctgttgtactgcctgttgtccactgtctgaaaacaattttatgtttgtttatggaggcagtctgatatgacttattctaacagatagaagtagaaatctgttatagtcttttaattactgtgtctttatagtattatggtagacagaatcctaagatgagctgcagtgatctttgctcttatataatcacttcttcctgagtgtagacaaagccagcgatgagatatcactcctgtgattgtgttacaatttatggcaaaaaagttagcagatgtaatcgagatcccaaatcagtcgaatctaagacagagagattatcttatgagcttgacctaaagaaggtgaattccttggagggactgaggtcttcctggagaaatgtgaagtgcaggagggtttccaggcagggtgattctcctctgctggatggagaaagcatgcagtgggaacgtgggaggcctctaggagcagcaagaggcccctggctgacagccagcaagaaaacagagatctcagtcctgcagtcacaaggaactgaactcagctgacaacctgaggaaacttgagaggaagttcttccccagaccctccagaaagaaacccagcctagtttcagcctgtgaggccctgagaagaagacccagctaatccaggcctgaacttctgatctgtggacactgcaagaaagtaaatcattgttattgtaaccctctaaagcttgcagtaatttagtatgcagcaatagaaaattaataaaagtaaaatggagaagactttggagtggggacaagaatgaaatggtggtagagggatgcctgtatgctgagatggttgatgcctgtatggttgaattgggtctaccattcctcatctaattagctatggtctattaaggtgcatagctatacatgaatattggtactaggtgaatccagaggaataagatattgcattcttgagagtagatgagaacaccctgaattggtggtcaccgtatcatatgtcatatatcaggtccctctgggaaggccagaggaagatttacaggatacactagtgacaacattgaaggcttctttcttccccaaagggaaccaacctcccctcagtcaagacgttccaagtctctgaactggatgccaggttataaattcccactataccgactccatcaagcttctgtcctcagaactagagtttatcagtaaaagatagactcatgggagtctaggcatttattatcttattttatataaatcagctaatgtgcatgaacaaaacagactttgaagaaagaaagtcacagttaccacaggaaaacagcttcgacatcctcatgagtcgtcatgggtgttccattgggaggacttgatatgaggctttcctcctcatgggttagtacagatctgggggaaatgtcatcaagtactcgattcagagtgtagcagctgaggctgttgattcgttaggcctcctgcagctggagatgcaagtagtgcattttcagggccaccacatgtgcccttaggctagcattcttcagagccagaatccaaaaagccacagaagctctgagtatttccctttcctcggtcacccacataaatggcttcaggtccttctggggaaggcctggaggaagatttacagcatacacttgtggcagcattgaaggcttcactctttctcaagggatccaatctcctctctgtcaagaatctccaggtatctgaactggatgccaggtcataaattcctactatggtctctgtcctcagaactagagcttttctaattattacatacattgatttcttagtagatttcccatccattacattcccagacacctcacgatgattagtaatcaccacagatccctgcctctcaaggaaattcctcccaccttgtttctagatggccgcgtaccactgcctgtcctctactcttccagaaccctattgttctccctgacagcagggagggcaaatccatgcagcatctcccgccatgacctccagcctgcagaggagaggtgccacaggacctttacacgcatgccactgttcccctcacctgtgcatttcttaatgccttggcgaggagaatgtccctggatcttcattagtgggagctaaaggaacaaaggtaaataatgctatgggatccactgaaaattggggctgtggaaaagtggccactgaagtaagacagatgaagctattgtcagatactcagtgccagagcagggagggagaggaaagaaatacagacctcacctgcctctcacttccaggctccatcaggtgcccctcattgctaaacctaactagaagtgtgcatgcaggggagccagggatgcattttagaagggtaagccctgagtggcataagacaggatggaaatgagtggagagtggatctgtgggaagaaggaggggatgttattgggaaacaaaaggagaatactagctaataatgctaggtgacactaatattccaaagtctgtgctcatattcagaaaagaaagttcagcagaaagcactaaactaggagtcaagatattatattttcaactgttgttccaacagccatattataaaggaacagtttatttcatgcctttctaatttgacctaaagtgccaggtggcattggggctggcacagccttgctcaattatgtgttgaagagtacacagagactgccaggctgagggaagatgcaaaagaatagaagagacgctctcagggaacaagagaccacacggccccagagtcaggggcagcatcagccactgttggctgctcatttcccagacagagcccacaagcctcagccatgctttgcttctgcaagatgcttcttcaccttttcaataaacctgcctgaatttaagctgataggggtttatttctccttcatcataaatgaaatttttcaccacaacaatctccagtgaattgtgggcacagcaggcaggtgcatccctgcttctgttccactacctcccctgtaggttgaaaaggaggaggtactgaattacctccaaatgttcctctcgctctgatattctgtgattctggtttcttttcagctactttgtttttggaagcatgtatcctaaggcatccagctgaacaacctttgtctactgtgtccaggcattcctggtggtatttcagacaagactctctgggattgctgcactcacaaccactgaaacaattctatgaccatccatttcatggctacatgtttgctcattttgtgtgttcataaagggaggggacagacagcaaacttgcatgttacaaattgtatcatcttaaaaaggaaacaaggcaacactttgcaataaaaccttaagatgcattaaatttaagcctaatgcaataaagaatgcccataaaattcttatctaaagaatgcttagaaaattgttgaacaagggacatcatcatttaaagtgatatgaagaaaccttcttagctaagcatatgggctagattagagagaaaataaaggacccatctcttccctggaaaaactactgatagcatctttcaaaaagctctctgtgattgaggatgcaccttgatccataggctcacatttgattgcaaccggcagctacttcttggcattgacattgcattcccaactagtaaatccttccaagatctgagtttctgcagatatgatattattttttttgaccatccttatcttcaaaggctaccaaaaaggaacaaagattttatttacctccccaagggaaaaggttttaccaatgagacactttcttaccatgaccccagggccccctatgccctgttcacttgagtgccctgtgtggcctgacagaagctcatgctggtcacaggatttgttacataattaacctccttcctgaatcccaacttcatggtggtggtgatgacaggtgtcctgtatcccaggctcatgtccctgaagtcatcagcctgtctccagttagaaaaaattacatgtatatagcgaggtctctttggaagtagcaaaagctttctcaccttcatacattaatggttggaatgtacaatagtataaacactttgggaaaaaatgtctggcatattcttacagaactaaacaactacctattctatgactcagtaattcctaagcatttatccaagagaaattaaaacatatgcccagaaaatgatttatacaagaatgttcatagcagttttattcacaataggaaaaactggaaacattcaagtatctgtcaatacaagaatggatcaataaactttgacacattcattccatggaatggctaaaggaacaaactgttgacacacaaaacaacatggatgaatctcaaaaacattttgagtgcaacaggagccacacacaaaagagtgtgagaaaaaagataaacaataatggtttcaagaaatgcagagcagagagcccagaggcaaagacccacaggatggcaggtcagtcccaggctgtggatcctaattaagaaactcctgctggattttgtccagctccatttccaaactattttaggtcagtgacttctttatcccctccatgttccctcattttgaactagaatcactgtagttgttattctatgtctgtcccatcatttcaaatgaggggcagataagctgtttgttcagtttcacaggtcaaaggaggtaagggaattatgtcaaggatctgtactcagagaaggtaggagcttgagaaggactccatgagttattattggttgatgatggaaaagagaggtaaggaggaaagcaggtggcctctggagtcagagtgtctcccagctgacagtcagcaaagacaaagggccctcagtcccccagaaacaagaataggaaggccttcagtatctgtagtgaacttggaaaaatagcttgagctctagaaaaaaatacagccagcccattcctggattttagcctcacatgactctcatcagagaatccagctgcttcattccagacttctgtggtttcaaaccactggtttgtggtaatgtgataataggcagcaagagaaaactagtacaggtgcctgtctctcctcttgaatttcaattttagatacatggatgctaacccctctaagagaaaaaaattcaatcaataaatcaatcaatgaaagaactaccataaaaatattgccctcacctttatgtggctgttccagagcccttgccacctgaagaagacaatgagggctatttcaggcatgtgaagagtgtggctttactgttatcaatcacatttctgaaagaataaaaatggttcagttcaagccatggctcatgtctgtaatcctagcactttgggaggccaaggcaagtggatcacttgaggtctagagttagagaccaaattggccaattggagaaaccttgtctctacaaaaatacaaaaattaccccggtgtggtggcaggtgcctgtaatcccagctactcaagaggctgaggcaggagaatcacttgaacccaggaggtggaggttgcagtgagctgagatcgcgccattgtattccatcctgaggaacagagcaaaaactccatctcaaaataaataaatgaataaataaaaaataaagatggttcattacttaactccacatattattatatgaaaatgtatcacctcaattttaatagcagattttttaaaattccttttcttgtgctcaccagacaaggtttggtagcaaataccagtcaccagcacagatgaaccaattcaaggagagccataaacaggactaatattatgttcccccaaaaatcatccctagaatgcaatctcttctctacttgtcacaaaacgaacacaatagtccactatataaagtcccaaacacaggaaagtgtaaatataatgaaatctgctttccaaatgtttattctattcagacccagtcatggggaccagggattaggaaatgactacaaacaggttcaagggaatttgggaagtgacaaaatatgctgaagtagaactctgctgatggctgcacaattcgataaatcaacttacatcattgagttgtacattgacaatgggtgacttttataacaagtaattctttaaatgaacttttggatttctattccaacatggaaagagctaggcggtcatgacttgtcctcacagctagaaaaaagctgaaggaactgaaagtcaacccttctagggtagaccagagaattgaggtcacagggaaaactgccatctgaaaaatgagaaacacaggctaacacacaaggagtcacagctcacagggaagagaagctactggggacagcaagtgggaggagcacttaaatggtattgacagattactagaagctcagggtggcctggctagagcactgaaaactccttgaaaaccaactaagggggaatatcacacatttccaagttttactacaatgatctcaactaggttctcatgatgaagttcagaaaaactccctgaagtttggcactaccaacttcagggcttatattaagctacagtagcccaaatagggtgaagttggtgaaaagagaaaacacacacaaatagatccatggaaaagaatacagagcccagaaacagacctacacacagtccactgatcttccatgaaggtttagagacaatttaaaacagcaaagatagcctttccaactagtggtgctagaacagctggacaaccacatgcaaatgtatatagatagatagatccaggtgtgcatgttctaccctttataaaataaatcttacatgtaaatgtaaggtgcaaaaccataagaatcctaggagataacataggagaaaaatctcggggatcttgggttcgatgatggcttcttagatacaaaaccaaaagcacaatctactaatgaaaaaaaattaagttgagcctcattaaaattaaaaacttctgctctgtgaaagacactgttaagagaatggaaaaagcaagtcacagactggcagaaaatatttacaaaataatctgatggaaaaactgctgtccaaaatatatgaagaattctgagaactaaacaacacaaagcaaaaaaaaaaaaaaaaaaaagtaggtgaaagatctgaacacctcattcataagatatacagatggcaaataagcatatgaaaaagatgctcaaaatcatttgtcgtgagggaactgcacattaaaacagcaatgagatatcactgtaaacctattagaatggctaaaatgcaaaaaggtgaacacaccaaatgctgtcaaagatgaggagcaaccagaactctccatagctagtggaaatcaaaagagtacagtcactctggaaaagttaagttctctcaaaatcctgcacataagtacttagagcaattttattcataattgccagaacttggaagtacccaagatgtcttccaccaagtgaattaataaacaaactgtgttgtagccatacaatgaaatctgattcagtgatttttaaaacacaagctatcaagccatgaaaagacatggaggaacttaaagtacataatgctagaaagaagtcagtctggaaacctgcatactctatgattccaactctaggacattcttggaaagtcaaaaagatagaaatagtaaaatgatgagtggttgtcaggggtggaggagaggaggaggcacgaaatggtgaagcacagggaattttcagcagtgaaactattttgcatgatgctgtattggggatttaggacattatgtaattgccaaaacccataatctgtgaaactcaaagaatgaactctaacgtaaactatggactttagttgataatgatgtatcaacagtggttcatcaattgtaacgaatgggctacactaatacaacatactaataggggaaattgtgtgctggaggacaggggagcctaggagaactctctgtactatccactccatctttctgtaaacctagaactgttctaaaaaataatgtctattaatttttttaattaggatgcagcagccccatatcaaggttttggtggcatcctgttattgtgtggttagtacttggcattgaagtgcaccaacctggagtcagagcagttggagatttcaatgcctgtgccatttacctctaaccctggggtgcccccggaatacagctagcagatcagttaggtagaagcagcctcagcaatctagacagtgcaggcttctggtaaggacaggtacaaaccatctgggtgggcagaacttgatgaagactaggaaccactgagactcagcagctgccccagtggcacccacaaatcaaaggagggggctggaaggagctcagggctacacgataagctccctgcctgcaagacagaagcagctccagagattttggtaaataatgtaggtttcagtaccgtgtggtctattcaaaaaagtagaacaaaaaggaaagaaaaagagacagcatgagagagagagaaagaaaaaggaaagaagaaaggaagaaaggaaagaatagagggaggaaggaaaggaagaaggaaggaagggagggagggagggcgggtgggcaggatggagggaaagaataaagagagagagagttggagggaagtagggaaggaaggaaggaaggaaagaaggaaggaaggaaggaaattaacaaatttacatgaagatgagaacatccaggggaacttacaccaccaatattttccattaacaggaacatgctaactagttattagagagagacacactactgtgaaaccatatactgtttccatggggtacaacaccttcctcctcctctgaaacacattctgtctctggcccactgttgccagagacactgagtcttatctttggataagttctggtgcccacaggaatgagatgagatggtggactccagaacatcaggccatgacctttcctgctgctccttgtccactccagaagctatccagctgcaggtgggggcctcagcccctgggtctgacataatccatttgccattctcaatggacttctctccttgcactggttcccactcccccaggacccagtgggtgaccacatgagaaggacacaaacaggccatgtccctttctttctccccctctcaatgcctgcagtggtgggttccattgggtagtgacctgagatttactcattatggggcctctagcccagaccagggcctggtacctaatagtcaccccatgaatgcccagtgaaagaaggtgtccaccacaaggtcctggggaaccaagaattccaccgtggcccataaattctaagtcctacaggattctggaattggagatgggaaaggccttcaaaagtggccactcttttaacctattatactggcaactgagccatgtttccccatcctggacacatctagagggcactgcctaaaaccagacacatctccccacccaggacagagcaggggccttagtctgggggatgcgggtggacagggagggggtgagccacaaaagctgaagaggagaaagcaggtgaaagggtacagcagggtggaaacacagaggaatggaggcagagaatgggggttgagaggggaagagacaggagagggatgcagatctagctactaaggaaaagtcctggagagaacactgtcctctcctgaagtaaaatcactttcacctgaccacagcacttcaggttgagggtggcacaggctgtgaatatttgttcattcatttaacaaatatttatttaatatcagtttcatgccaggcaaggccctgagatgtttagggaccttggcatcttccctttacatctgagtcataatagaaagagggccctctgaccccatcaagctggcaatgcctcaggatttttacctgttggatctagcagctcttcatgtcggcccacaccatgtgaggctgctcttggtgcactgaatggggaagtttctacgtcagtgcctcggagagtccactggaagccctggacagtgggagtcggtggcaccccaagggtggaggccaagagcacacagcactgaagctccagacaccctcaggaggacggtaagggactatcagctggtgagagcctgggtcaccaggaacctttgcctgggtctaaataggatttgccttcagattgcctatgaaataaaagaaagaaatcaaggttaacattgagatttggggcttcagcaacttgaaggatggagctgccatttacagagactgggaagacccagggaggagcaggttgaaaggtggtggggaactagagttggttgggtttctgtcatatgtaatcaacagtcctgaccacctgtaatcctagcactttgggaagccaagacgggtggatcatgaagtcaggagatcgagaccatcctgcctaacacagtgaaaccccgtatctactaaaaatataaaaaattagccgggtgtgttggcaggtgcctgtagtcccacctacttgggaggctgaggcaggagaatggcatgaacccaggaggcggaggttgcagtgagacgagatatcttgttactgcactccaggctgggtgacagagtgagattccatctcaaaaaaaaaaaaaaaaaaaaaaaaaaccagtcctgaccagcctgggcaacatagtaagaccccgtctctgaaaataaaaaatgaaaaattagccgagcatggtggtgcacacttgtagtctcagctactcgggagtctgaggcaggaggatttcttgagccttgagttagaggttactgagctatgatgacaccactgcactccagcctgcggggaaaaaatagagtcctgactaaatacttgagtagccagggaagttttcacaaagtatttgaggcagatcttagtgaacaagaatttgattatttctgttagggaattaagagagtgtgggtgtagttgcttaatgcttattgaactatctttggaatctcatctattggtctatctggtctatctgtacatgtatattctatacactgtctcactgaattttcactaggttatgctacagtaacaaaagccccaaaatcttagcagctacacatacaaaggtttatttttcattgacatatacctttttggcaggttgactatgattctgctctatacaagctattttatttgttagacggttgaaaactgtcatacttggagattgttgaatacggtattagtatgttattcattcattcatttaacagatatttattcgatatctgtttcatgccaggcaaggtcaagtactgagaatacagtggtgaataaaagagacaaaatctctaatttccaggagcttatgttgaaaatgagattgaacacatacaaaataatcataataacaataatgagccctctccctctccctctccctctccctctccttctccctctccctctccctctccctctccctctccctctccctctccctctccctctccctctccacggtctccctctgatgccgagccgaagctggactgtactgctgcgatctcggctcactgcaacctccatgcctgattctcctgcctcagcctgccgagtgcctgcgattgcaggcgcgcgtcgccacgcctgactggttttcgtttttttttggtggagacggggtttcgctgtgttggccgggctggtctccagctcctaaccgcgagtgatccgccagcctcggcctcccgaggtgccgggatggcagacggggtctcgttcactcagtgctcaatggtgccaaggctggagtgcagtggcgtgatctcggctcgctacaaccacctcccagccgcctgccttggcctcccaaagagccgagattgcagcctctgcccggccgccaccccgtctgggaagtggggagcgtctctgcctggccgcccatcgtctgggatatgaggagcccctctgcctggctgcccagtctggaaagtgaggagcgtctctgcccgtccgccatcccatctaggaagcgaggagcgccacttccccgccgccatcccatctaggaagtgaggagcgtctctgcccggccgcccatcgtctgagaggtggggagcacctctgccccgccgccctgtctgggatgtgaggagcgcctctgcccggccgccccgtctgagaagtgaggaaaccctctgcctggcaaccgccccgtctgagaagtgaggagcccctccgtccagcagccaccccgtctgggaagtgaggagcgtctccgcccggcagccaccccgtccgggagggaggtggggggggtcagccccccgcccggccagccgccccgtccgggaggtgaggggctcctctgcccggccgcccctactgggaagtgaggagcccctctgcccggccggtcgccccgtccaggagggaggtgggggggtcagccccccgcccggccagccgcccagtccgggaggggggagggggggtcagccccctgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggtgggggggtcagccccccgcccggccggccgccccgtccgggaggtgaggggcgcctctgcctggccgcccctactgggaagtgaggacccctctgcccggccagccgccccgtccgggagggaggtgggggggtcagccccccgcccggccggccgccccgtccgggaggtgaggggcgcctctgcccggccgcccctactgggaagtgaggagcccctctgcccggccagccgcccagtccgggagggaggtggggggatcagccccccgcccggccagccgcccagtccgggagggaggtggggggtcagcccctcgcccggccagccgccccgtccgggagggaggtgggggggggtcagccccccgcccggccagccgccccgtccgggaggggggagggggagtcagccccctgcccggccagccgccctgtccgggagggaggtgggggggtcagccccccgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggcggcggggggggggtcggccagccgccccgtccgggagggaggtggaggggtcagccccccgcccggccagccgccccgtccgggagggaggtgggggggtcagccccccgcccggccagccgccccatccgggaggtgaggggcgcttctgcccggccgcccctactgggaagtgaggagcccctctgcccggccacgaccccgtctgggaggtgtgcccagcggctcattggggatgggccatgatgacaatggcggttttgtggaatagaaaggcgggaagggtggggaaaaaattgagaaatcggatggttgccgggtctgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctccttaagagtcagcaccactccctaatcttaagtacccagggacacaaacactgcggaaggctgcagggtcctctgcctaggaaaaccagagacctttgttcacttgtttgtctgctgaccttccctccactattgtcctatgaccctgccaaatccccttctgcgagaaacacccaagaatgatcaataaaaaaaaaaaaaaaagatatggaaagattgtaagtaaaaggatttttcttaataaaaaaaaaaaataataatgaatactatatttacaaataatagctgtaagacattttagcacctgttttaaattagaaaaaatatagaaattattaaaactaaaatggccagatgtgatggctcacacctgtaatcccaacactttaggatgccaaggtgggagaatcaactgagcccaggagtttgaatctagtctgggcacgataggaagaccacgtctacaaaaaataaaaaattagctgggcacggttgtgtatgcctataatcccagcactctgggaggctgaagcaagcagactacttgagcccaagagttcaagaccaacctgggaaacatgttgaatccccatcgctacaaaaaatacaaaaattagccaggcatgacagcacatgcctatagtcacagctactcaggaggctgaggtgggaggattgcttaagccaggaggtggaggttgcagtgagctgagattatgccaccacattccagcctgggcaatagagtgagaccctgtctcaaaaaaaaaatgcaaaaactaaaataaaattgctacaagattaatatataaaaatgagttcatattcttaggctaggcattgatttcttttttctttctttttctttctttctttctttctgtctgtctgtctcttttttgtacaagacagagtcttgctctgtcaaccaggccggagtgcagtagcacaatcttggctcactgcaaactccgcttcccgggttcaagcaattctcctgcctcagcctcctgagtagctgggattacaggtgcccatcaccacacctggctaattattgtatttttagtagagacggggtttcaccatgttggccaggctggtttcatactcctgacctcgtgatccacctgcctaggcctcccaaagtgctgggattacaggtgtgagccaccgcgcctggccgggcattgatttcttaaacaggacacaataagcagtaaccataaaggaaaagattaataagagtatatttcattaaggctaacagaaaaatgtgttcatactcttagactaggcactgatttcttaaacaggacacaaaaagcagtaaccgtaaaggaaaatattgataaagcataatttcattaaaattaagaaactccgccaggtgcagtggctcatgcctgtaatctcaacactttgggaggccgagccaggtgtatcacttgagcccaggaattccagaccagcctatgcaacatggcaaaaccccatgtctactaaaaatacaaaaaacagctaagcatggtggtggtctcctgtaggtcccagctacttagggcctgaggcaggaggatcacctgagccttgggaggtcgaggttgcactgagctgtgattgtaccactgcactccagcctgggcaatagagtgagatcttgtctcaaaaagaaaaacaatttagagaatctccattcatgagaaaacaccattaaaagagtgaaaacacaagctgcaatttgaaaaaagagaaatgcaattcatatatatcctagaaaggaggcatatccagaataaagtattacaaatcaacagaaaatcatatcaatgaaaactggataaaaagattaaacagtcacttcataaaagaggacacataaatggcaataaaagatactcaatctcaataccaggaaaatggaagttgaacccacattgatatattactgtacctctactagaataacaaaataatttttaactgacaagcatcagcaaggatgtggggtaactggaatattccctgctaattggtaaaactactttgggaaaatgttcggcaatacgtaatactaaagttttatcattcatatagctctaaaaccaacaatgccactcctacatatacaccccaatacagtaatgttctatttcttaatctgtggtggttcatttagtaaaaactcatgacctgtacttttttttttttttttttttgagacagggtcgcactctgccatccaggccagagtgcactgacgtgatcaccgctcactgcaatatcaacctcccgggctcttttgaccacgcagttaatttttgtatatttagtagagatggcattttacccaggctggtctggaactcctgggctcaagtcatccgcccaccttggcctcccgaaatgctggaattacaggtgtgatctaccacacccagaccacctgcacatttaaaattgtgaacttcctctgtattcttcagtaacttttcgaagatttctttgacacgaagttctcagaaatcttaaagctaggattttagaatagaaaaaaaaagcttttggttcactggtgaaattttactaattaaatttaaaaacaaaaagaaagttattaatgcatatcacctcagaacaaagattaaaaactacgagcacatcagttttctttaacttcgtgaagcactgggattcattctttcggcaaagaaaggatgaacaacactgtaactcaaagaaaagataccactgcaagaaaaggccttttttttttttcttttttctttttttttttttttttagagggagtctcgctctgtcgcccaggctggagtgcagtgacaagatacctcggctcactgcaacctccgcctcccgggttcaagcgattcttgtgcttcagcctcccgagtagctcggactacacgcgcccgccaccacgccttgctaatttttcgtatttttagtagagacgggttttcactgtgttagccaggatggtctcaatttcctgacctcatgatccgccacgtcagcctcttaaagtgcttcttttcgaaagcagctccaccagcaaaaggtaggaggaaagcgaggaaaccattccaaaagtcttggttaactcttgggtgaaaggacgccaaatgagatgatctaagaagcctcaaggaaagaaagacagacagacaggcacaggaaaatcacagcaactctttggactgcaaacaccaacaccacagtccaacctaccagaaatcctgctgtgaatttgaggcttgtcccgctagtcatgaggtgattcagtgatggctacaaacgctccttacgtgcatcctggacctggtacacctggcttgcccatcaccagcctggagacaccgccaggagcacaatccctgaggccaataaagaccccagctttgcaagtcaggggcgcgagcactcttgcccctcaggttcccagaagaaaccgccacgagggtggggtgcggggtcagtgtgctccacaggacttccgaggacgtgccccccaagctgctccgttcctccaccccctgggatgccacagaacacccgccagcgagtttcttccccagcgcccatgagaggaggctgcgggcggcagccgcaagcgaggaatccagcgcagggaaagtagccccagtggggcccggcgcgtcagccccactcgcgtggcaaaacttgcgggggcccccgcgtgccgcgcctcagcccagctgtgcgcccgcaggtcccagactcgccgcccgcctgacctggcgcggcgccctcacctcggaacgctgggtggacttcgcagtaaaccttaacttcccatccaggcggcagcggcgcggtgcctcggcttcgctcctggcaccgcaggtcgcccgttccgcgttcccaaaagcatcaggctcacttagaagctcaggcagcctcgcgaccctcacctacccctcccagcaccgccgctgtctctaccgccgcccagcgcaggcgtagcagagacttaaaaggacacggccgcctctaccgcacaacgggttggagcaggttaggggccgcaggggctgagaaaacgagtaacggaggacagagtgcagtggggacggggaaatccctctcctccccctctttttcaaagcaccagcccttgaccctgcaattcgctgatttccccggccactggaagcgcccctgccaggttaaagaggcgggagacacaccccctctggagccgggagctaccgggcgtttaggactccaggcctcgcccttccgcaccgccccaaagtctgacttgcaggctcgggccgcagacccgcaggcttcagaaggcagccccagctcccccgagaggtggccttaggtcactcgcaaaaacagtaaccaacgtgtcgatggcacttgtattttctaatttaaatttataacacatttcgcagatgggcttccactgaaataagcctttgagaaaaagaaaaacttttttttttcaacaagattaggaaataccaagacatacgaagtaaagccatgccgtccacccagctaaaaactttgaaaacttgaaattttatctaaggcaaatgtttgcataactttaggtcgtgccattatttaaagtaaatttcaattaacaatatcttttgcaattgaatccatcttctataagaaaactaagatacatccctgataatctacctctcccctcctgtattccatccatcagcaaatcctactggtttttaccttccaaattttccttgaatctgtcctcttctgtctcctccatcaccaccctagtctaggctaccttcacctggggagtgggggtggagggactactgacctagtctccctgtggtttacccatatcccctttatcgcctctctaatcttaacacaacaggcagagtggctttttcaaaatataatgtgaaccctgtcacttcccagcccaaaccacttaagcaccttcccattctcttagacaaaacctcctaactaaccaagccctgaatggccaggcaccttgcccacctctccacctcttctcacaggtcagaccaattccattcttttctctctgctccagccaaactggcctcttttattgcctatttacccagcttcctggactccacagagcttttgctcatgctttgctctgtgcctgaagattcttccaaccctcatcattctgacaacagctgtagtctccacctctgagaggcaacttctgacctccctacagtggtcccttactcttatcacattgcataaaactgtaatcgagtggttatgttggggaattttttaccatcagctccataagtccaggatttggttttgtttggctcatgcttgtatttccacatttgtgaaatacatatttgttcataaatgagaacgatcgatgttagaagttgaagtaaatttggcataaagtcagagaaaggtaaaatgtcacaatctaatatttagagtcagaatctaaaaacttcagttatattaaaactgattttgtatcattttaggctgggttgtcgcagggattctttgggtaatctttaaaactgagttctcagagagcattgtataaacacctgaattaataatgatagccatgggatggtccacataaaactaataatattggttgcttcaagggaggaagaccaagccaggaacagtggctcatgcctgtaatccaagcactttgggaggccaaggccgacagatcatttgagctcaggagtttgacattagcctgggcaacttcgtgagtccctgtctctacacaaaatataagcaaaattagctgggcttggtggacacctgtagtcccagctatttgggaggttgaggtgggaggattgcttgagcccagaaggttgagaggctgcagtgagccatgatcatgccactgcactccagcctggatgacagagcaagatcctgtcaaaaaaaaaaagagagagagggaaagaatcttgactggtggctactggtgggaaggaggtttttactacatccccaattggacctttttattttaaagtatctgaagataaataaatgacacaaaagagtgcataccatcccatttatttgaaattccagaaaaggcaaaattaatctgtggtgagaaaatcataacagcagttccttctagcaggggattcactgggaaggtacacaagagaaatttctgggtgctaaaaatggtctgtcttgataggggtatgaattacttaagtgtattctttcatcaaaaacattcagttaacattcaatgaatgtaaatgttaccttaaaaactataaacataattaaaaatttaaaatctggtcgctaacacctggttgagcgctcagtgtatatggggattggccaaagctataaatacacaattttgtttagtcctcatactgtcctctcaaggtaagtattattatcataatccccttgcatatgaagaagcccaaatttagtaaatactaaataacttgccttactttatgccacctggaaaatggggaaagagctttgaaaaccatcagtcaaatgccagaagttattaaacattagaccctataacacttctctgaaattgtaatatttttggcatatatatatatatatatatatatatatataactcatctactagatcaagagcttcagaatgattgaaatcatagtttgtgttttgtttgtttgaggtttatgtgtttattttatgtcattattttaaagactgggtcttggctgggcatggtggctcatgcctgtgatcccggcactttgggaggccaaggtgggtggatcacttgaggtcaggaattcgagaccagcctggccaacatggtgaaaccccatctctactaaaaatatgaaatcagctgagtgtggtggtgcatgcctgtaatcctagttactcaggaggatgaggcaggagaatcatttgaacccaggaggtggaggttgcagtgaggcaagattgtgccactgccctccagcctgggccacagagtgagactccatttcagaaaaaaaaaaaaaaaaagactgaatctcactatgttgcccaggctgcacttggactcttgaattcaagctatcctcttgcctaggcgtcttgagtagctgggactacaggcacacactatcacgcccagtattttgtcttaagtttctaagcagtcccaacactgcacagtagctgttcaatgtattttgagtgaatgtttaaaaacaagcttggtgttgattttattgctacaatttatatttacatatgtaatatttatattatatgctttctatatatttatatgtgtgtatgtatataattggcaccaacttagcattgctgtgcttaagtgcctgagatgtatctcaaatgaataggcctgaggagagaagcttgtgtcattagctctgaccctgcagcactaatccttatttacccctttctttcactcaccctgagcacataaatatttatttggtgaaagagcttacactttaacatcgcactgaaatagctcattccaaagaaagagctaattctaacctctcacaagtgcttgagcatttgcataagtgaaatttcactgtgtgagtttcacccaacaccacctctgctccagctcctgctactctactgctcataccatggaactccacaggtggagtagaagatggaggatgcacgatgcagtacacagcagcatcctcctcagagagagttttatttgcagtaaattcagtgtgcaataggcaaagcaacgaagagtcaaggtgaggcaggagagcagcagagggaagtggaagttggataaagagtgaactgagtaggagcagaagcaggttaaaaaggtgggtgagcctagaagaaaacctaggcaataccattcaggacataggcatgggcaaggacttcatgtctaaaacaccaaaagcaatggcaacaaaagccaaaatagacaactgagatctaattaaaacaaagactttctgcacagcaaaaaaaaaaaatatatatatatatatcatcagagtgaacagacaacctacagaatgggagaaaacttttgcaatctactcatctgacaaagggctaatatccagaatctagaaagaactcaacaaacttacaagaaaaaaacaaacaaccccatcaaaaactgggcaaaggatatgaacagacacttctcaaaagaagacatttatgcagccaacagacacatgaaaaaatgctcatcatcacttgtcatcagagaaacacaaatcaaaaccacaatgagataccatctcacaccagttagaatggcaatcattaaaaagtcaggaaacaacaggtgccggagaggatgtggagaaataggaatacttttgcactgttggtgggactgtaaactagttcaaccattgtgaaagacagtgtggcaattcctcaaggatctagaactagaaatactatttgacccagccaacccattactgggtatatacccaaaggattataaatcatcctgctataaagacacatgcacacgtatgtttattgtggtactattcacaatagcaaagacttggaaccaacctaaatgtccatcagtgatagactggattaagaaaatgtggcacatatacaccatggaatactatgcagccataaaaaaggatgatttcatgtccttcgtagggacatggatgaagctggaaaccatcattctcacaaaaaaccaaacaccgcatgttctcactcacaggtgggaattgagcactaagaacccttggacacaggaaggggaacatcacacgccggggcctgtcatgaggtggggggaggggggagggatagcattaggagatatacctaagtaaatgacgagttaatgggtgcagcacacgaacatggcacatgtatacatatgtgacaaacctgtacattgtgaacatgtaccctagaacttcattaaaaaaaaaaaggtgggtgagcaagaagcaagataagcagaagttgagcagcgaaaacaaaagtgagatggagtagtgagtaaaagcttatggctggcaggatccagagcaaaccagtaagaggcagctcctcagagataggcatgggtatgggagagaaaaagtaggcttaaaatgaccccgtatgataatcagctcattaaagctaatgcatatggactgcatatcatgggtgtacttaaaattatgggatggaggtgaccgggaagcacactggggccaaataactaagcaacccacctatcaatcagaaggcacatgctgggtagagattaggcagccccaggaaaaggagaaaaaatatatatataaaaagacccaaagcccaaagttcaccaaactgatgctgatctcattttgcagaagttagcctgttctcccctctctgagagtgttactgtgcttaataagtcttttgctgctttgctacatgtgtgtgtgtgtgtcacagccaattctttgtttgagacaccaagaacctgggacttcacaacaccagccagtaacaaagatatgtaagcttgggagggaggaaagaaagaagggagcaagaggagattcagacatgagatgcattcaccctatgagttgaaccccagtctccagcgtgggagttggcaattctattactgaaccatcaatgctccatgtggtataacctctcatgatttttgtttgtttgttttgttttgttttgctttgttttttcaaaaagagaatctctggtggtataggcaggcatgaggggtcagggaggatggaggtgggaaagttctataataggctgacacagatatttttggaaaacagagctaacaaagcaacaggcacttgaagcaaaggcttgccctaaaccttccactgtttgccaagggaagaaattttggagtcaaattttcactttctctcttgtgtagatctctgtaagacataaaagtttggatgacagtcattttgattcttggactttactagagactccaaagacgcatctgaggagaaaagctctgggtccctgggatgactgtgccactcgacatagcctcctggagtggccaaagagagtgtggttgaaaaaagaaatattggagtgaactttcactcactcccacttttgtaggtttcttaaaaacatgagtttagaaacaagatactgggctttttcaaatgactcaaaagaggtgtagatgaagagaagctcgatcatcccacagatcttttggagtaacctggacacatccctaaatctccagctcctgggtctttgaaagccagtttgtctcagggttgggaggcaagtgtttggaaagcaccaaggcaggagttggcaaaaaggttacctcatcagtgaagaaatgaaatttccagaagttttcaccagatctgggaccagagacaaaggcctggatgaatttcctatgcaaaccttttttagaacctctgtttcagagttcttccagagactcttcaaaattagatctggtgaaaccgctgctggtggtggattggtagttcagcagcagaatttttttctcccacgcgggagactcggtccgactcgcggccatgcaggccttcttacccttcaggcaggaagggctactacctttctacccaacaaagttattatattacccaggctgtactgcatttatggaccttggtcgtggcagctacaagttaacctgaggggcgtgccacctctggagcattctctgtgctcgaactaatcccgggatttacagttcctgtgctcgaagcctgtccttgaaagtgaggagtgtttccagtaggttgctgtagttttgaatactgggaattaaaacctttgctactttcatctagtctccggggcaaacccctgggtaacccaaaggccatcagacggattcgcgtgctgggctttccactaccttaggccacgtgtcactatggagcgaagatcaagaaggtcccggaaggagagaagctgcggggtccagggagactttttggtggttggtcggagaggcttcagctgcccaaggaaaagggaagcgtgtggggaggtatccgcatagagatgagggcctcggcggagacagtctcacgcagaggtatgccaccttggcatctgcgccttccgtgggccagtgggtcttccgggagggattctgtgtccctggtattgtgtgtcaacaggtgttagcctgatagttatatttttaatgagagaaaacgaactacagaatttgcgagttttgttttttttctggttttgctttatacctcttggattctccttccaaaggattccgatctgaggggcattggggtgtgactatggtagacaaggagtggtgaattttcatccaaaaatctttggcggattcccttgctctcccgctccccagtctaacagtagtttaaaacagaagatcagcaacatttggagagttttttttttctctgcattctgatgataaacttgatttattcaattccaaaaatttctttattctgaggttgtctttctatattttgagtataaaaccatggccatacaatgttggacccaccaaggttcttctcttcacttgtttatttgtacagtctctttgtaatctcagaatttcttgagtaaactgggaactgttatacataattctgtgtttttgagcattctttgtaaacaggaatcaggattgggggtggggaaggagggaggagtgggagtgctgatttgtgtaacggaaaaatcatagattacttatgtgatggggcaaaggttttaaaaactcttagtgtcctcagatttccccttatactatttgctgaagaaaatcatgtccttgactcccttccttaccctctcctggcaagggaaggggtcccctcctgcctcagggtctctgtcctcctggggttaggagaagcgcatccaactccctctccaagtgctggagaggaggctaagtctttcccatgggctgggggctttgctgtcccaaggacggctggggaggaagaggaggcagaggcggaagaggaggcagaggcggaagaggaagccggctgagatttgtgaagcagctcttgctaccgcgggtaggagagggcgcgcgggacccaagagcctccgtgcggagccaggcctcaggagcagccgccttggtcctggaagggatgcctccctccatcctgtctccaaagaatgtagggagaccttctcacccggtgggaaagcgacgtctcccatgctttcccaccacggacgccttatgtcccttttcctgctagtgtctgaccgccagcctgcgggggctgcggctgcaacggttccaagctgggtggaggctgcctgcccgcgagccaagagccacgctaggaggcaggagtcgggaagtcgtgtgcaggcccggaggagactcaagctacgggtcaggcttttttgccaattgccaaattcagcgtgtaaaacagagagctcacatctgtctgtttgtaagcttcggtgagaacaacaaggaaggccctcaagatccctaggagggcggcgaagggtctctggcgaagggtcaccgcgtcggcggtgagccaaggtatgtcaggagagagtgcgaacccagcccccgggtagcacgaacaccaccgcagacaagggccccgcttgtggggaaatcgcagggccagtgcagccgcagtgcggtggactagcctcatccagggagaacccccttcctgaccacggtctgtcccccgccaggtaagaggagaggagggacagtacagcctcctgtcccgtagccgcaggctcagggtcaccaccttcccctctgcttggccggcgccattcttccaaaccactctccgccaaagattccacggacagtcacctacaagacaacccagccgtcctttcagcagcggatcccgccccgcagccaccgcgccctctcaccccagcgcttctacccaccgcctctgcccagtctgtgcacttcacctccctcgccccggctcccctctgagcttacagtggacagggggttcgtccccaacccttcttgggaatactgaatagaaaagggaggagcgtgcgcaattccttggtagtgtgtagacggacattgtgggatttgactgtggtaccatcgctttgacgtcctagtgatttttacacctgccttctgcttagaacaccggccacagttttccatttgtgtctactccacctgctgtctttgttggataagtgaacatcgtccccctctaccactcaatcaacaaaagggcggtcctggaggacctcacccgccgctcacctgctgctcacccccctcccaaccttgcggacatcgcctccggtcgcctcttcgtaaggcctaagaagcacgttagctgcgaacggaggtgaggaggctcagctgaccgcctgtgtcagctgacaacgtgtgacacgcacaaacgccaggacttggcttggcctctctcttagttatttgcagctctgcccaatcggcgcctccgggacggcggagacggtgggcttcttgggtgcagctccacgaaggctggcatccctgcacagcggtgaacacctgagggagacgctcagtctctctctaaagccacttctgcggatgacacggagataaataagagcagtgtgtcatgagaggccgtccaccaggacttgccctcctttgccagggtttgcacctagcagagagactgttctgcctctggcccttggagcaggctggctgacagcggagtaaagaaaaattactgcgggtgtgcagtcagtgcaaaacaattctctgaccgataattgaacccgggatgcggtggtgaaagagctgaatcatagccactagaccagcacgggggcacgggagggtctttctcaaccttcttgccatataagtgactgtttccctgtgcgctgggaggacttgggccttgtgggggtcgttggtcgctcctggagtcgtctcacaaggcctttccctccctcctttctccaaaagaggagcccggaggcgacgcacccagtactctgcgaggcccaccaaggccacgagtcccgagtcctggagcgagttgcagcgtccaggctgcacctgaccactgacctagaaatgtgcctttgcgaagcggcagcgcatggagaaacagtcgctggtggccagggccagagtcgcgcaccgggtagccagaacaggcaggagcgaggaggctcccggggtgagaacggggcaccccgcacatcataaaggactcagaccttggcaaccccgacatcataaaggactcacacggatgtggaaaccgagacgagctggatggaaaactttccaggggggctccggggccctcaactgctctctgaccttcccctgcaacctgcgacacctgccattttcccatcttaggcgacggcaacgctacccttccttatgctccaggcaaaactcctagagttccctctgacgctggagttttttcctcaaatccaaaatccaattggtcaccaattcgtgatttcccgtcggccaagtgcgtgggcattgatctacacgcgaatttctccacctcggcggaatggccacttaggggtgggggaggggccctccggtggattgtaaggtgtttagcagcatccctcgcctccgctgactagatagatgccaggggttaacattctccctccgggcttcccctagtctggcctagtgtcccagcggggatgggggagtagtctgagggtgaagttgccgcctattgagaaccactggtgctcatagtcctgccctctgagcttgtgcagaggactctccagatgaaggctcaggggtcgatccagctcgagaccccctcgctccccccgcacagtcggaccttaaaattggagggttttaacatctcgacatcatgagattctacctttaggtcttttcttccgttctgtccgccaaatcggcctcttccgagtttgttgaccagggccagccaggcagaaggctggtttcgctcaaagaggatcccctcgccctcctggagcttcaggcctgtttccgttgggtctgcagagaagccttaggggccacttccttcggcatggggagggggaacaggtgctcgctgcgcggggaagaagagggtttgactgctgttctcgacccccagcgccaaacctccaccccggtgcgcgcccctccaggctcctgctggtcccactcgccggtaattaggtctccggtcagcctcagctcccgagacacccaggcccagaaggacacgtaagggaaagcagctattcacttcggtcctgtccgcaagggatccctttctgacgggaaagaaaggtggcgagtcccgttctgttgagtaagcggaagagagatcaaagggaagagaagaaaaatcctgtgaggtttcaggatctaaagttaccatgaagtcgacctaacctcgtctggaggtcctcccgtggctggcgaaggtgagtcgagtctccgtcttcagtttgtcaaagtggacaaagcctacgacaactgccagtaccagctactaggcatccgcagtctttccagttggtggtactggaggtccctacccaggatttccgtggattccaagggtacaactaaacagcttttgttgttccaactgctcttatttgaagaaagggccgatctgttgagaatcacataggaaaaccacttccataagagtgtagctactgttgttgagactgtcacattctccctcctcctccttcctcttcctagaaatgtgcaatgaaaattaatccccacgatcggcctgttgtactttcaatgtacagttggcagaacctaaggtaactctaggaggttccgggatgaatatttgaagtatgacacagtcatttttatttgcacgtgcattccaaaaacacattggacaaacacatccagttcacctgtgccacacttacaaagacgcgaaaagaggggctacatacaaacaagtgaaagatgtaatcaaacggcttttaaatgtctgctgtttccactgaaggtcttcttctctggatacacctaccagtgtcttctctttctccaaaaccagacattcaagtgccagaccctgaaatcagttttctggttccaacttgttcttccccattctgtatctctgcccctccactctcttctttcatatgcaggaaagttcagctctccctcagtttccaatttgcaacatcccattcgaagaatgcaatgaccagcatcaaaaattagacaccttccatgggactccgtctctctcttagttggagcttctataacaatgtaccataaattgggtgactcatcctaaacagacatttctcacagttctggagttttcaagtctaagatcaaggtgccagcatggtagggttatggtgaggaacctcttcctggtcgtagactgccgtcttcccactgtgtcttcaggtggctgaaagagggggaaagagctctctagtgtcccttttatgggggcactaatcccactcaggaggactccactctctggatctaattacctcccaaaggcccctcctaataattttaacacatttcctggggtgggcaggggaaggttagggttccaatcaaggtattttggggggacacaaacattaggtctcccgtgatctttctagaagaagaaattatacatgacccaaagttttgtacatttcacagttagaaataaagaaaactttttctaagattttgaaaggcctgaaacgtgaggccaaccaaccccatcactaaaatctggactctgtgctgattgttgtggactttttgcgtgttcatcctccctgcagacaactgaagattcattctctccagagggtagaagagaagatgtattgggagaacccacccccaatatttcaaagtaggttctttctattttccgtaagtgtcagctggctgaaaaataaagagacagtacaaagagaggaattttgcagctgggccaccaggggtggcatcacatatcagtaggaccatgatgcctgcctgagtctcagaccaccaagttttcattaagggtttcaaaaggggagggtgtgtaagaacagagagtaggtacaaagatcacatgcttcaaagagcaaaaagcagaaccactgataagggtctaacaaagatcacatgcttctgagggaacagggcaaagggcaaaagcagaaccactgataagggtccaacaaagatcacggggcaaagggcaaaagcagaaccactgataagggtctgtgttcagtggtgcacatattgtcttgataaacatcttaaacaacagaaaaaagggttccagagcagagaaccggtctgaccacaaatttaccagagctgagttttcctaaccctagtaagcctgagggttctgcaggagaccagggcttatctcagtccttatctcactgcacaagacagacattcccagagtggctgttcatagacctccccccagggatgcattcttttcccagggtattaatattaatattccttgctagggaaagaatttagcaataagtttcctacttgcacgtccaagtaggccccctgcaagaagaaaattatggctctttttgcccgaccccacaggcagtcagaccttctggttgtcttcccttgttccataaaaattgttattattctgttctttttcaaggtgcactgatttcatattgttcaaacacacatgttttacaatcaatttgtacaattaacacaattatcacagtggtcctgatgtgacgtacatcctcagcttatgaagataacaggattaagagattaaagacaggcataagaaattataaaagtattatttgagaactgataaatgtgtatattaagatgaaatcttcacaatgtatgttcctctgctgcagctgcagcttgtccctctgtttgggttcccttacttcctgtaacaaggatccttggccccaagggggcaatcagcatagatgagcaaagacttgtgtcccacactgaaatgagagggatgaagtgacagcatatcttgatctatgtgatggttacataagttatgacctatttcaaagcttattatgctgtgtgaaaaagaacaaaaccagaggacttgcacaacctgacattcagactcactctaagctgttataaacaaggcagtatgcaagcggcattggaagacacaaatacatcaacagactgacttgggagatctgaaactgaccacagctgtaaggtccataggttttttgtttgtttgttaatttctttttgttttctgagacagggtctcactctgtcacccaggctggagtgcagtggcctgatctcagctcactgcaaactctgcttcccatgctaatgcaatcctcctgcctcagcctcccaggtagttcatactacatgtgcattttagtagacatgaggttttgccatgttgtccagactggtctccaactcctgggctcaagtgatccaccagcctctgtctctcacagtgctgggattacaggcatgaaccaccatgaccagtcacaggttttcaataaaagcagttcaatggggcaaaggaaatagtttcaattaattgactttcacaaagaagaaaggggagatgaacaaggttatttctccctcacactacacttgaaagtaacttgaggcacattatagaccaaaacttaaaagctaaagatataaagcatttcaaggatactttgtgacttgttggtagacagagatttattaaacagggcacagaaaaaaaatgtataaaggaaagacttgataaattagacttcatcaatattagccatatcttctcatcaaaagatgccacaaagaacttgaaaaaatgaatcagcctcagggagaaaatagtcacaaaacctatctgacccccaaaccctgtaactataatgtatggtgagatcttcttacctggtaacgaaaacaacaacaacaaaacaaaaacaaaaaataatcaacccaagtatgctagaagggtaaaagacttgaacagatacataagaataaaaggtacacacatggtcaataaagcacatacaatatgtttagttatcaggaaaatggaaattaagaccacactgagacaccactataactcccagtagcatggctaaatttatagggagaggaaacacccaatcttggagaagatgaagaacaaccacaactctcacacgtcattggtggaaatgtaaaatgacacaactactttgggacgttttgtcattttttatgaacttgcccatatcccactctttggtaccagcaattcggcacccaggttttcccaagagacacgaaaacagatgccctcaaaatctcttgtgagaagaaagttcaaagcaggcttattcagaatagccaataccagtttattcagaatagccaatatccagactctcattatgagggtgggggtggggcgggaatggcaaacaaactgtgctgtttctttgcaatggaatactactcagcaatgaaagaggaatgaacttctgctacactcagcaatggatagagccagagacattatgcagagagaaagaagcatgtagaacagagtagatgcaccgtgattccatctgcgtgaagttctagaagcaaaggtaaagtgaaaacaatctggagagtgattgttcacaaataaggcagaggacaacgacaatgatttttataattctagtgattacgttgttgattgagtagtcactaaatccaggcacatctgacaacaacggtgtaaggcagagtttgcgaagtggcacaaccttccatagaaaaaatgttgaggcacataaaatgtaagatacttaaccaaggtcaggcaaggactgacacagatttccaacacagaacctgggttcttggacatagattagactggacctgtccacttctctgtttcaggtgtctctgggattctcagctgcaccagaggagagagagaaggacagagaaggagacagagggagagaggagtagggaagaaatggagggaggcacagggcctgtagctgttgaagagcagagaagtaactcttgccagtgtatttacagtatagaaaagttttctggcgatcaggacattagcagatgctaagcttgctgtggtcaggagatgaatttgatatgccatagatttagaaattaaaacgaaaccctaaagttattggaagagaatgtagcagaatacatttctgccttaagagataacaggaaaaaataaagcaaagtagaatttaaccaaagttatcaacttctgctcatcaagaatcaccatgaaaagggagaaggtgagccacagactgggagaagataattgccccgtgtttacctgaaaaaaaaaataactcaaatcttgaatatagagagtactttttacaaatcagtaataaaaggcaaagccaattgaattagggaaaatgcttcaatagcctctcttctcaaaggattgctaaatggtgaaaacgcattagtaaatatgctcaacagcattactcattaaaggaaacacaaattgaagccatgatgtggtaccgttttacatccaccagaatgggtgtatttaaaagacagtaaacaccacgtgctgtcaaggatgttcagccagtggaactctccttgctggtgagaaagcattctggaagaaaccatttggccgtttctaataaagttaacattacacctaccatatgattgaacaattccagtacttggtattcctcaaaggaaatgaatgcacgtgtccacaaaaagaccccacacaagaagaatcttcattcgccttgtccagctagtggaatctgtttcttaccagcaggagtagaagtctgaacatttctcttggtatcatttctcttggcctcttggtatcagagtcgccaaggaaaatacaacgcagtcaagcactggacggaaaaacaacacattattcacacagagaggagacacagccgggtgtgggctccgcttcagtagtgggcgttggtcccccatggccatctggtccctccatttggcctgcacacacagcctcttgagaagcagaagaaagggcccctccccctcccctcagcggggagcagatacagcagctggccaggtgccagttgatgcacatgtttaagtggaacaaaggggtacacagtctgatcgggggaaagatactcccacacaaggaggtgagtccagcacaggctgtgaggactccttatctcttgggaaggaagtgctccaggcccaaggcccattcctacccggcagagtggaggtggaaagacccctggcacgagattgcctttccccacactttcctgttggcatacaaacttggcgacgagctgggagacaagccattgtaggccacaacaaagagtttgaagtttaaagtcattaaataacagccccagtgactggaaaacaggttctgagggcaccattgccttcgtgtaagccaccaacagggctgactgggttatttgctgtgtgaggctcggaaatggacggagcacgtccagcgcttcccttggattcctcgccaggttagtgggctgtgaggtctcttttcctttccctgaggcgcctggttgcagggagcgaaagtggatagctgacggcctggaagaacgacattgccgtgactcggattcgaaccgaggttgctgcggccacagcgcagagtactaaccactatacgatcatggcgagccacaggccaagcgatgatagctgagcttgctctactaattttgacatcaatagatttcgattattaggcggctttgttcccagacagctacagggggatcgcgctattctttcatacccgctctgcttttccctcccttcctcccaatcctcatatgtgatgagaaaaattcttatctcctccactccagcctgggcctctctcgcgaagtctctctgtcctcattcgcacctcctctacttctctccggcctctccgtatttctgcttttcacccttcctctctcccgccggaccgaccgaagcagaggtgagcgagggtagcgcaagcagcgtagcgagtcaggtgaaggcggagccaagaactgcgagagctgtcactagagcccaccgggcgttctgcttgcttcccttcggacccacgcgattcaggctcagggagtcgcggacccgggcgtttccaggatgctgggtctgatgcctgcgaggggcaggacgaggcgaaggccattccgctgcccttccagcttcagaatcacccaatgcacgggtttcaaccgtagccggcaagctgcccctctccggttttccgaggctttggagcctgcacaattgttctacaaaaggcggtggctccgcctaacgttagatggacgcttgctctgcgtggtgataccagagcgagagtcgactgttcctgtgtcgcagtcgggtggtgtgcttgcttccaagtctggaggcgggtggttcgagctcgttctatggaacgtttcctgcattttaaaaatgcttaaaccgctggcaactttcttctatccagcacatgcactcatggaaaggcagagcgagaccaactttaccctcctctcatccctctccctctccctccccctctgcccctccccctccccctccccctccccctccctctccctctccagacggagtctcgctctgttgccaggatggagtgcagtggcgcgatctcggctcactgcaacctccgactctctggttcaagcaattctccttcctcagcctccagagtagctaggcttataggcacaagctaccacgcccagctaatttttgtattttttagtagagacggggtttcaccatgttggccagggtggtgtggatctcctgacctgatgatccgcccgcttagcctccccagagtgctgggattacaggcgtgaaccaccgcgcctgacactctctgtcattcatttagccctttccatacgcttttgaggttaaattggttctgtgattttactattacatataatgctctagtcattcttgtatgggcactttcagccactggtgtaagtatttctatagggtagaggtgcaattactatgtggaaagcaattactctatcatagtgttcacacggtttttatatcattccattctctctcctctgtttgcttattagatataactctttcttttgttattttagtaattgccttagggcttatagcaaaccattttaacttatcacagtcaaccttcaagtgatattatacctcgccttctggccttgatgctgatgctgtagctgacatgcactttgcttttacgcatgttacaaaccccacaacacattgttattgcttttgtttaaatggtcaaatttttacaaaagaaatttacagaataaaaaaaaaactagtatagttacccatttctggtgttcatttcctcgtgtagatctggattttcatctggtattggattccttctgcctggaagactcctttgacgtttcttgtagtgtgggttggctggtagtgaattctttcagcttttgtacatctctaaatgtccttattttacttccagttttgataatttattttttgtggcatagtattctaggttaacttcccctgccctcagtaccttaaagatgttgcttctatgtctgctcatgtgcattgctgctcctggtagaggccggcaagagcagaaaggaagctgatgcaatcctcatctttgttcctgtgtatgtacaatgtatttttcttctggccggatttgagcaatattattatgaggtatctaggagtggttttcttcatgtttcttgtgctttggtttcctcagctccttgggtcactggatttataatttttgttatgattggggacttttcagctattgtttcttcaaaaattggccggacacagtggttcacaacttcaggaggccaagtcgggaggtgttgagtgaggcctgaaatttaagaccagcctgggcaatgtactgagaccccattcctaataaaagtaacaaagaaagaaataaatgtttcctttcccccctgctccttctcagggacttccattactcataatttaaacctcttaagtctgccctacagttcactgataatcttttattttaaaaaaatctcttttgtctgtgagtttcattttgcatattttcaattattcatggttccatgttccctgatcatttcttctgcaacgtctaatctgctgttgatcccatccagtgaatttatcatctctgatattgtggttttggcgtgatatcggctcactgcaacctcctcctcccaggttcaagtgatcctccggcttcagcctcccaagtagctgggactacaggcatgtaccacgataccaggctaactttttgtattttgagtagagatggaggtttcaccgtgttagccaggatcgtcttcatctcctgactttgtgatccacctgactcagactcccaaagtgctgggattacagtcgtaagccaccgcacccagccccctcccttccttccttccttccctccttccttccttccttgagacagggtctcaccctgtagcccaagctggacttcagtggtgtaatcttggctcacgcaacttctgcctcccaggctcaaacaatcctcccactgcaacctcctgagtagccgggactacaggcacacaccaccatgcctggctaattatttgaatttttttggtagagatgaggtttccttatgttgcccagtctggtctgaaactcctgagctcaagggatcagcccacctcagcctcccaaactgctgggattacaggtgcctgtttgtttgcagagaggagcagtgagcagatttcaggcaggagagttaatcgggcatccgttactcaaactttgccgggagcctaaggcatctctttacatgttcttagtttgacttcaacaggaggtgtgtcagtttatcttccaacatatttttccaactcaatgagagagccttttccttcgtgctcttgccagcacagcagtttccatatatcagtctgatgtaccagtgagggggtggtgccctgcctgatttacctaagcaggaggtgcagcagaaagacatggtggacagttcccagagatactctctggcacgtgttccacagctaaacctccaagatgtttagaaagtcttccagtaattgtaattgttttctctggtgatctacctaagcccagagaaaactggctggagagaccctgaactgcttcctgtcaagaggcttatcaaataggaggggaaagaatggctccttctagaaatttgttccttttctcttttctttatgaattgcattctgcttttgttgaatgcaaacgatctacagactgttctccctcctagacaagggtgaattggcatgctaataactacctctgtgttattccttccttgatggtgtttgttttgttttgtttttctgtaaaactcatctcactggagacaaatctctggatcctgcacctcaccatgcttcttatgcagacctggatccttggagttattggctccctttgccttgtttattttgttgactctcttcagcaaaactgaactccaacttttacaccctaaatctggctcttggacatataggtccttttgctttctgactcctcctcaacccagccctgcctttccaacctctccatctgtatctgtgtgcctgtgtctgtctgtctgtctctcataccccaggctgcccccagtattacccactttcttctccccctcttcagtgttcagggtacaccttcttctctgcctacagagtcccacaggctgagggtgcgtccccttacagagaggggagctcattccagaaggtgccctctagacttggaattaaccctacaaacaacacccaggtttgaaaagctttttctgtcttcccattacctgcattattcaaaggactaaaagtggggagtccagtagaattcttgatgtctctcagaagcctgcattggaatgccttcattcaccgagcatatgttgggtgctcacaaggtgtgaagccttgctctaggtgagtagctgcatggtgagcaagtcctgccccaccgagcccacatctggaggaatcaaaagggaccgggcagtgggaacacaaccagctcgtgtcctccccacaagtgtttccccattcgggcacagggaacacaagcggtaagcatgacagataaagcatagcgaaggatggggaagtgggtgacttcagaccaagaggctactgtggtcatgtgcagtggggccacttccgacaggggaagtgcagggggacagtgtgggccagggagaatgtcgtggatctggcattcctgcatcttgccctcactcacatggcctggtgtcaactcagaaatgtgcccaaccacacaacttctggcctccgtgtcacctagaagacatctagaacccatgcaatagcacaaagaagtgaggatgtgcagcctggggatgggggcatttaataatagacaggtgtctgaggcagatgtcctcagatttccaggcaccacttgcctctttgtggagcaatcagggcaatcatcggcaaaaaactaaagactactcgtcctgttccatgcagaggcgtagttaaccttgtaactattcttttctgaccttcattcttccacgtccagatatatgggggtctttgttgcccatctgcttcaagttagatgaagaaaatcctgcctgaaggcttaagggtttgttagaaaaataaatgctgttcagaaaaggtgcattttaggcaaaagctcagttctggagctccagaacctacctatcccaagcccaatacacacctcctttctctccctccctgctcatcgcacctgccttcgctgattcttcaggctgcacatctctgagaagatgacaatccctagcagaagaacaagagaaccttggacacttctgtccatgaagccatagacgcgagcagatagcctcattccatggcggtgtgactctgaagtcactcaggttttctgtgcctccatttccacattgtaaaatgggcccaataggaatgagtttctgaatgggttgttccaagtttaaataagacacggcagtaaaacattgaacacacaccctgatgcatagtaaacgctccaagagcagtagccattattactatcattatcatcggtggcttcatgacggctattatcgttatctacatccatctttgaaataattgcatatccttttagggtatggagggattgcaacatataacaaatcctaactgatgaacatttcttattacaaatattgctgctgggaacatatttctgtattttaatcatcacctgtgtgtttctctatcaaatcttctcacacaatttggggatgttgcaaaagtcattccctgaccgggaatcgaacgcgggccgcggcagtgaaagcgccaaatcctagccacttgaccaccagacacagaaatctccttgtcagaggaaacaagagaaggtaaagattaactttctaagaggaggagagccccactgaaaatggctctctgtgacccaagcgggctgcaggactgcagggctccaagcagtcactgcccagctgctcaacacctctcacctctgctagcctggccactgctttgggctgtattgaggacaggccacaaggaaactgagcggtgttccattctagccttgctgtagcatggtgtgaggcagagccaggcacttgctctctttccgagcctcagtttccttgccaccaaagtgcggacgtggctctcagagggtgatgagccgagtccttctagttcccgatctctgaactggctcaaggggctctaccgataaagacatgtgtaggggtcccctttcgcccccaactagctcaattagtagagcatgaaactctgaatggatgggtctttggctcgagctccaggtgcagatttaggttcattttcttttgttccgccacacaattcgaccggttccgcaactgagctcgggtcgcgaggaagccaagtgggcttcacaggaaagacctccttggtttcagagacattgtagctgtcagcttgaaatcttcagaaagaagatttcggcgatagatgagaagactggaaatttctggatctaaagctaacatgaagtccgcctcatccggcgccctcgtctcccgatccaattcacggcgggcaaaccaggcctggttcctaatgctcagcgaagggtttcaggtagtaatggaactcctcccgtgcttccagaagctgctgcagccggcggggtttgagcgccggagttccgggcggcagtagtgtggaccccgcccctccaggtctatgggccccgcctcgggaccttatccctggcgtccggccttcagggctcttggctttgacagggtaccgactttcgtggtccttccaggagctgcaggaccctgcctgcccgcccttcactcaagtcaaggggcctcatccctgtgctctttcctcgctttgggctctccactcagggtgtcaacagaggtaggtcaggtgagaaacctggatttccacacacacctggctacaaggagatggcaccactccccttctcctgcagaagcagactcagaaaaaaggtaattaaaacagaaggtttcaataaaatcgagagtctgataacataatacccaaaagtccaagtttctattgaaaatcattcattacactaagaaccagaaaatcttattctgaatgaaaatagacagcaaatacacaccggcaataagatgagagaggggtcgggattgtctgacaaagattttaaagcaagcaagcctgatgaaaatgatgcagtaattatgagcacattcgaaacaaatggacaaatagaaagccttagcaaataaatacaagacttacaggagaaacaaatggaagtattagaagtggaaaatacaacaaccaaagtaaaaagtccggcacataggctcaacagcagaatggatggtgcagagcaaagaaatccatccactgcagatgaaaaaatagaaattacacaatcttaacaagcaaaaaatagactgggtgagaaagtgaatagaacctcagggacttgtggaactgcctcacaaggtctcactttcatgttgttatctatgtctggaaggggaagaagaagaggaagaggctgaaaacataaagaagtcaatggctaaaagcttgccagagttggcaagagacagaaacctacaggttcaagaagctgtgaagaccccaaataggagaaaacccaaagacgtctatggcaagatacatgaaaaaataaaatgtaggaaatgaaagacaaagaaaatatcttgaaagcaacagagaaaggtgacactttacctagaaaggaaaaacaattctggtgatgatggatttctcatcagaaaccaaggaggcagaaagaagttgtgcagtgcttttcaagccatgaaagaaaacaattgtcagcccagactcctctgtccagcagaaacatctttcagggattaagaggaagatcaaaactgtttcagattaagaagagctaagggaatctctgaccaccagttctaccttaaaacaaaaggctaaagggagttctctagacagaaaggaagtgattaaagaaggaaccttgggacatcaggaagaaaatttaaaaaaaaaaaaaaaaagtaagcaaaataggccttccttcttctcttgagttttctaaactatgattgacggcttcagaaaaaaatcatagcatcattcaaagtggttctaactctccaaaaagaaaatgtttgaaacaattataaactgggagggtgaagagaccggtaaggaaggtaactcatctatcattcactcatactggtacaacaatgacaccagtatactgtgtggtaagacatagatgcacagacatatgaatatcagggaaaaccaagagggctatccaaacagatatatgcaaaaacactatggataaggcaaaacaccattctcaaagacgttcaagtcaccacaggaaggtaagaaaaagaaagcatatccagaaaacgacaccagagagaacaaacacaaaaagaaaaatataatggcagacttaagccctaccatatcaatcatcatattaaatataaatggcctaagtacaccaattacaagacagagattggcagagtaggttaatggacatgacccaactacatcctggctgcaaagagactaccttcaaatatgatgatacaggaaagttgaaatcaaaaggatggaaaaagatacatcatgcaaaccttagacaaaggaaagcaagactggctatattaatgccagatatagtatatttcagaacaaagaaactaatcagagacagagagggacattatataatgaggaaacaaccaatccacgaactcctctcctgacaaaagtcataaatgtctatgcaacaacaactgaaagtactgaacagagaactaggcaaatccacaaatatagctatatgcttcgaagttcccctttcttaacaatttatacaaaaaccagacagaaaatcaacaagaatatagaagaacccaacagcatgatcaaccagcggggcttaaattgacaattttagaacacccaaccacgtcagaatacacattgttaagggatgcattgtgcccggcccccccagattcatatgttgaaatcagaacattagtggcaactagtaatatactagttaaaatcacaatgagaaattgctaacatacctatcagaatggccaaaagaaaagcatgaccacatcaagtgctgtcaaggattcagagaaagctggatcactcatacattgctggtggaaatgtaaaaagtgacagcccactctggagaatatctgtatagtttttactttttaaactatatgtgcaactaccataccacctaggaattgcattctctgcatttatcacagagaaatagaatcttatgttcacacaaaatccatgtacttaaagtttatagcagccttgtttttaatagccaaaactgggggaaaaatgtatagacgactttcatgaggtgaatggttaaacaaactgtgatatatatccatagcactgaagagtcctcaataattttttaaaaaacaacaaactattgatacccacaataacctggatgaatctccacagaattatgctgagtggacaaagggtaatcccaaaggtgacatgtaggagtccatttatgcaaattattcttgaaataaataaattataaaaatagggaatagattagtagttgccaggggttaaggagggaaggaggagcagcactgaagagacagggtcatggctataaaaaggcaacatgatgaatcctagtattgatggaaatgttctgtaccttgcttgtatcaatgtcaatctcctggtacagtggcatttgcaatacatttgcaatatttgcaaatattactaagatgttaccattggaggaaactgagtaaaggatacaagggacctctctttttctctctgagttcctaagattgtatgtgaattattaaaatgtaaaaattaacttaagaaaacctaagtatatttctcctttactgatcatgcctttgcttaaaaacattaaggcaacaatatttttcccaacaccctttattttcttgaagacagttttaacaaaagctgttcttagggcttttcctaaaagtttaaaacttccagtaatccttactgttcttctttgagaaccctccagggttttgttttccaaaagaataaagacaaaaactggcaactggcatataatactatattagtcttagttctccagagaaagaaaatgagcaggatacacacacatacacacacagaagcagagaagcccaagttctactctgagtaagctctagacctaggagagtcaaatatagttcaagacaaagtccaaggcttaaggcagaagactgatgtcccagctcaaagacagtgcagcagaaaaacttctttcttaacccttcatcctagtcaagccgtccatgggttggatgaggcccactcacactcaggagggaaatctgcttcaatcagtttactgattcaaatgtcaatctcttccagaaacaccctcagagacacagtgagaaatcatgtctaaccaaacatctgggcactccctggcccagtcaaattgacacaaaaattaaccttcacaaatgctctcaatagaagtgattaataaatgtagcatcatgtactgcctgtttatcccgtgacaattaatatattccagcataacattggcttctgttcccttactgtaggaacacataggagtttcatttaaagtgaggataacttttaccttatggagtctctccctacccgtacctaccattgccacttgtggattgtcattttgccatggctttcttattcataatatcaataagctgtatactttgctaatgtaagtttgaatttcatcctggctgcataagtcactttccattttgacaaagcctagaaatatttttgtttatctcctgtatattggtaacacatacctattgtggggcccactctcaatctcatggttttctttattttcattcagctctcaatagatatgcctaggctgcttgaacatcactgaaaatggcctgtggccttgtccatctatcagagtccagtaaaatcctggccatggaatggggggatggaaagtgagaaccaccaaactcagcacacaaagactcagtttaaacctctgcgctaagagatgaccagactctatcatggctcctaatagcataagaccatgtcccatggatgaccctaggctcccatgacaatgcctacctaagaaagctcaaggctaccaggggaacttactttagttctagccaatacctgctgatgatggtaggttctttcttatagcatttactaagaagggaatccctcctccatccctttgagatatgtatgtatctcctagggactccagtgtgtctttccacaggatttgaaagccattccttttaggtgtagtcctcaggaaggacagaatctctgtcttccggtctctgtgggaggttaggatcctaacatctaatattgccagctggcagaaacagctgtcctgatgaggcagaagcttacaatgatcaatctttcataatgtttcacttgtgccctgaccctgccctctcccctgcctcactctctcattagaatgccatcacctctgcacaaacgggatggaattcagccccctctgctttggtcagtagttactgaataaaatctgttttcacagctttgactaatgtctgactttatctttgacaaaataagtgcaagcaattgttttgagcaacacagcagccacaaagagaggcacagacatgtcgggagagggaggaatcatctgacccttctcatttcacaggcatctattcctgcctggtgtttatgagcctgagacttggctgggctgccctggtgtatcactccatggctctggggcaagacttgagtaggctggtggtggcacttggtgtgaccacagccaccttcaaagatgccattaagggttcacaagaaaatgaaaggaaacatagagaaactgattttgaaagttgttgcctctcctgcttcctcattcagagtgtgtatgatattgctgtgtgatgttagttggactgcaatttagcacaacagctgttctaataattggcagtttctcatcgagttaagcctacctgaaagggaagcacacttacctttattgatcacccccgttaaatgaacaatacatccaacaaggcttctaccaaaaatgttcttattaacctcatttgtatactaaggaaaaactgggaacaacacaaaccttcatcaacagaagaatttaatacggactgttatatagtcataaaacgatcccagaagttcgctgcataacatcaaacccaggaacccacactgatgccactgatggcagaaaatcttgatacaaaaataagagagacgagagacagaaaatgtgctataaccatagtagtgggtaaaagccaaagagctcagtttctattcatgatattcgatagaagaacagaaggaacatgagccaatagctctaagggtccaggtctgcacaaggtgcctgttgggtgcagggttctgttggctccagtgttgtatctcaaatgggctaatttttatggacatagccactgcagaaatctatcaaagaataataaagggatagctatttgcatgttaatttaccattgtataggagggagaacgggccttagattggtttggtcaaataaaagcaaaaccgagatttatgaagaaaagaggaaaggggagaggaaaaaagtcatctgggaactttgtgattttgctccccttggataagcgacttgacagaaagctgtcaaagaggtcattgtgacccatcttctccatacccacatgacttggtcaccacagaaaacaattacagatgttggaggactttaaaacatcctagaagtttaacagctcatcctatgccacagaatatctgtgagtaatgtccaccatgtccttcggttgtacaccccctcagttaagccaggaggacgcctcttccctcagtggaatatcatacgtcgatgtgtagaaagttggttgtgccagcaagtaaatgacaaaagggacattgatagaattgggaaacacattggagtatgatttgctactgctcccacggaagataaatttgcagaatgtactcaaattagaagcattatataaatgctgtaatgtaaaaatggcacatcctgttctctacactatagaaatatctgcatgagtgaccaaagatatgtgtacaagaatggtggagattgcagcatcatttgtaatcctaaagtcatgaaacccacctcatttcaaaaacatcttgaaaagggttaaatcatgcacaaacagaggaagaaatgctgttttcacaaacaatggcgaggatcaccatgaggatgagtgattccactggtcacattattgatagagcaatcagtaaacccaggcacatcctgagaataggatactactgtaatagctctcctattactaaacatgaaaaactcgaggcactttactcccacaagccttccatgggagcaaagaacatttttatcacactagaagtgagttcctctctaaggtctctgggattcctgagtttgacagatacaaggcaccatgggccttgccaagcctcagccctagaagatggggaggaggacatgtgtgtctcctgattaggctggagttgattgtatatcaacagaaacaacaaaaatcaaatcatgaactatttttctatggggaagttttgttttgttttgttttgcgacagggtctcacttggtcgcccaggctggagtgtactggtgcaaacaaggctcactgcagcctcgacctcctggggccaagtgatattcttgcctcagcccccaagtagctgagacgacaggctaatttttgtattttttgtagagacaagatttcgacatgttgctgaggctcgtcgcgaaggggaagtaagttctttttaaaaagcatttattccgattgatttctccgcatcctgtggggcgcgcaaggggcaaggcctcccgtggcctctcttgccactctgaaccagggagctgtgggggctcagctgcgttgtttttgggtgcgtgtctggggcaggaggccggggccgggcaaggggtgaatccaacagggaactgcgaggaggagggcaaggaagtcggtagaggcatgcaccagggaaacttcccagtagctttgtgcagcgataaggactgcacaagggagagatgagaagtgttttcttattgtatcagaatggggaagaaaggggggaaaaacggagagacaccaagaaagaacgaaatctacgcggacccttgggtctccaaaagggaagcagtcctgcattaagtttaaagaaggagcgcggcgcgcttcagctcctgtggcttgccgtgatcttattgtggttagtactttacgcggtggccgcagcagcctgggctcgaatcccagtcgtggcaacgtccattctagggtgtagcgctcttctttccctttagcctctaacctcagcctaggctgcgctgttgacctgcggctagagaggtcacaactttcctgtgacttcggaactctctgtggtgtcgagaatagaaggaaaccctaccctgaatgcctaggggtccggttatcttgaaagacttttcctcctctctgagcaagtacaacacccaaaagatgaggtgccccctctcagtcagccttattggaatctttaatgttaacatgatgtggccgtacccgtttttctggctcagatatttcaaaaatccgtggggcctttttcaggccaaatcagaaatgaacaagagaagatgagagttcgcactccaactgggtattttaagcaaaacctaaagaatacaataaaatctaaagtttgtgactttctccaaccccaatttttaattttgtttttatttatttatttatttattttgctatcagtaaatgattgaagtataatccacagagaccaaagtgcaccaatcttaagtgtgtgagccagtgcattttgacaaaagaaaccatcacctatgtcaagttatggtacattttcaacagaccaagaagtcattagagcccctttccagtcaatcctcaccccatccccatttaggcaatcaccattctgacttctatctccgtgatttactcttgcttcttgtagaaatcacgtaaaggactacattgattttacctgttttcttttaatgcaacaatgatatgtgatgcttccattttatgacatgtatctcagctctttggtgttattgatgagtgttattccaacatgtgaatatactacagttgatggacaattgggctatttctagttttggctattgtgaataaggtgtttacaaatattctactatgggtctttttatggacctgtgccttcatttctattgagtataaatctagtaatggaatggctgggtcataaataggtgtatttttaactgtattagaaactatcagacagtattttagaatggtggcactattgtattttctctctctctctttttttttttttttttttttttgagacagagtctcgctttgtcacccaggttggagtgcaattgcaggatctccactcactacaacctccacctcacgggttcaagcaattctcctgcctcagcctcctcctgagtacttgggattacaggagtgcaccaccatgcctggctaatttttgtatttttagtagagacagggtttcaccatgttggccaggctggtctcgaaatcctgacctcatgatctgcccacctcagcctaccaaagtgctgggattacaggcgtgagccatcacacctggcctatatgcaaacttctgtatcagaatagaaaagttgagaagatagtacacagaatggagtaaagaggatggaatgggtttttggaaaccaattcacaatttaaagttgttttaacacccctaatccccaaagaaaaatgtatattctccaaagacatccctttcttaaaatatgcagagaaagtgtgggataaaagagcatgtagtaaacttctcagaacgtgtgtctggaagtggacaggggaatgggagtgggatgaacagagaaaagaaggaaagacagtaagggccttgctgagagcagccaccataatgtgccctgagctaaggtacatgattaccttcttcctgtgcacctgagatctaacagaatgtattgacttatcagggatatggaatttcaaaaacactacaggaaatcaaaaaatttaccaaaacagaacagtctagttaagaaaggcaggaagagattttataaacaaagcaaaaacacagaaatcatacagtgaggtggtgggaatgagactatgcgcatcgtctccaatataacactaattactgctaattataatggatttaagtatctcatattggatagaaaaggaaatgccagctctaatgctttaatggtggaaaagggttaaatattcaaagcagtgcacattattattgttagtagtagtagtagtattttgagatagagtctcactcttgccagactggagtgcagtggctcgatctcggctcactgcaacctctacctcctgtgttcaagcgattcttctgcctcaggctcctgagtagctgggactataggtcgcgcgccaccatgcccagctaatttttgtatttttagtagagattttagtagagatttcatatcggccaggctggtctcaaactcctgacctggtgacccacccgcctcgacctcccaaagtgctgagattacagatgtgaaccaccgcaccaggtcaaaagcagtgcacattatcattagcaagctagcccagaaagagaaaaccaaacaccgtgtgttctgacttataagttggagccgaatatgagaatgcttggatacataggtttcgggggtgaggacaacacacactggagcctgttggaaggtgggggttgggaggagggagagcatcaggaagagtagctaatggatgctgggcttagtacctgggtgatgggaaggtcagtgcagcaaaccaccatggcacacatttacctatgagacaaacctgcacatactgcacatgtacccctgaacttaaagtaaaagttggaaataaaaaattttttaaagtcaagaaaacaaacaacaaaaagagtagtgcaaatctgtaccatgctcatttgtaccactcttttgtttgtaccaccaaacaaaagaatgagagtgaaaacatgaatatctgacaaaagtaaacagcaaaagaacactttatgttaggagtaataccctagcatctacctagaatgaaatgaaactgtttttccctgaactggcctcccaagctgaactcttgggactgtgcctgggatgctccaggagaccagggtgataattgaacttccctcctcctacacctctatcgagttcctggaaaacgccagcgatcagatcttgcttttaacttcttatactttacagagacctaaacaagagggaagaaatggacatttcatgccaagatttcttcccttcacctcacactcgagttcctgggttctgacggccttttttgaggaaagtgctgatgtttgcgtcaaggttgggaggaaagggtttgggaggtaccaggcaatggggaggcaaagagaagacatcaacaagcgaggcaagaactttccacaggctgacactggatacaagaccagagacaaaaagctgggtgaatttctgatgttttcctacagaggttttttatccagttgcacacagcctactcagaataaggctttttcaagtcaacccttttaatgtgaagccataattttgtggtgttgcctgatgcaaatctccactgtgagcctttgctctgggtgtcttttttgttagtcacatcttccaaagagaacatggtgaaaatcttgactcctttccccaagtctgtgtcttaactgtttccaaggctgcagagctcgggggtcaggaggcattggcggtacagtggcagaattctcgcctcccacacgggagacctggattccatttccggcaaatgcagcgtcctgtctttgtgccctgtggttttcacatttacttactgtgccacgctaatgaagaaaaaaaaaggagcggggggtcgggggaaccactgtgtactcctcaggttctttccgtagcggaatttatttttcttttatttatttatttttgtttgtttgtttgtttgagacagagtctcggtctgtggcccagattggagtgcacttgcactatcctggctcactgcaacctccaccttccgggctcaagtgattctcatgcctcagcctcccaagtagctgggattacaggcacatgccaccatttcctgctaatttttgtatttttagtagagacggggtttcaccatgttggctaggctgatcttgaactactgacctcacatgatccatcagcctcggcctcccaaagtgctgggattacaggtgtgaactccgccccggagcggaatttacctaagcagagactctctttgaagcagcctgtgggtctggttggtctccgcgtttctacatatttggccctaaaaccggcacgacttttatcgtctctgttgttggatctctgcagtacaaagagtcacctggtcactgattctctgcctggaccttggatagaccattgggacacatcttgcgatggagtgcgactcaagcaatgacattcctgaaaggagagaagctgtggggttgggcggacacacgcaatgttggggaactgggacccagggagaggggagacgtgtgagaaggaacccacgtgcagatgaggggagctgcagagaggggcctcggaccttcctgttgaggaaagcccagtctttagtggtctcggcaaattaaaggattggccccgagtggagagcagcatatccccaaaactcatttctatcagccctgtttgttttacactgcaccaggcaaatcttctgtccacgggattctttttaatgcttctctttaagcagcgtggtggggaggccatggcgatcattagctctggaggcctggggaggacactctgaagaagaaagccctgcgattatccggtttcaccctgttttcatctactctttgcctcagcgaagtttatattgggtcctctatgttacatcacagctgctgcactggcggattaagagccgctgacaagtctctttcgggaaggggtaagaagcgcagctggcccagagccatggagagagacgcaagagcagaaccgaaaatactttcctccttcttgttctctctctgctattggtgaacatcaaccttccacacaaaccggttcaatactgccttggtctctacaggaggtttaccaatttttacagttcccgtaagccatgttttcttctcgtttctacagttcttccagggttgagtttcaggagctggtcagcagtccagactagttcaacatcctggttcaaaaccatttgtctcgtttcgctactagggtaaagcttgcctcctagaccagagttaagacgtgttccctcggcttctgttttctagagagaattggcatagtttcttccttaaatgtttggtagtgaaaccatctagacctggtgctttgttctggaaggttgttaattgttgcttcaattgcattaatagatagagacctatctaggttgtctatttctccttgtatgagttttggtcaactttatctttcaaggacttggtccaattcattgaagttatcaaatttgtgagcagagaattgtgcataatagtcctctactatccttttaatgtccacgagatctgtagtgagggtcattgttttctttttcatattagtaatttgtaccttttctcattgtttcttggctcaccagctaaaggtttatcaattttattggtcctttcaaagaacactctttaggttttgttgacatttttctaatgatttctggttttcaatttccttgatttctgctttagtgtttattgtttcttgtcttctactcactttggacttgatttgctcttgttttctttgagtttcctaaagtgcaagtttggattattgattttagatttttatttgtaatatttaatcttttaaaatccattattattttactttttgtacagtaattcttttagtgtaatataattttgttctggtaaaaatttcagttttattttatgtaccaagtgtacatgtataggattgttacatggatatattggacccaggtagttcacatagtacccaatagctagtttttcaacccactctccctccctccctccctacctcatggtagtccacagtgtctacggttcccaggtttatgtctgtgtgaactcaatatttaggttccgctcctaagtgagaacattcggtatttcattttctgattctgcattagtttcctccagagtatggcctcctcctctctccatgttattgcaaaagacatgatttcattctgttttatgggtgtatagtattccatgttgtatatataccacattttctttatttaatccaccactgatgggcatctagcttgattccatgtcttcgctattgtgaatagcctggtgataatcataggagtgcatgtgtctttttcttttaatgatttacatttctttgagtatatacccagtaacgagattactggttgaataacagctctgttgtaggttctttgagaaatctccaaactgctttccacagtgactgaactaatttacattcactccaagcatttataaactttctctccagagccttattagcatctgttggtttttgactttttaataatggccattctgagtgatgtgagatggtatctcattgtagctttgatttgcatttctctgattattagtgatgatgagcatttattcctgtgtttgctggctgcttggatgtcttcttttatgaagtgtctgttcatgtctctttgcccactttttaatgggattttttttcttgttgatttttttaaagttccttatagattttggacattagacctttgtcagattcacagtttgtgaatattttctcccattctgtcggtggtctgttgactctgttgatggtttcttttgctgtgcagaagctctttcattgaattaggtcttacttgtgaatttttgtctttgctacaattgcttttgtggacttggccgtaaattctttgccacggctgatgttgagaatgatatttcctaggttttcttctacggtttttctgctttgaggtcccagtatatattgtgtcattgcaaatgacaaccaaccagaaactaatcattacaagccaagaaagggaacttattggtgaccaggaaaaatgtccaacaaatgaaaattagtaaaagagattcctgggtgtctttttctgtaaagcctggggcattgttgtctgcagagttcacattttctgtaaagggccagggagataggaagtattgtaggcttctgagccaagaggcaaaattaaggatattatgtaggtgcacatataaccaggaagaaaacaaatttctaagccatttttattgatgagattctaaactaacaatagcaactgagtagaacttctcaggtggtaaatgttcgctgcattgagagcctaggctcagctttcctagaatccctggtacagccctccctttccaccccttaggctgtttcctccctgttttcctcagaagagttccatacaaaagacctactactctgagaaacagtgaagtactcctggggcccaccaaagcacacgagtcaagaagtggatggccttgtcccagctatggctcagatcacctttgcaggatgacatcttgttgggagattgtcatcagagccagggacatggaagatgctgtcagaaggatgaaaggactggtgcccagggggagaagtggccaagcaactctgcattcagcctcacaaaaatctcaaggggatgtagaaatgggaacagggcgaatggaaaactctttcaagcagggttttggggtcctgagctgatctctatttttcctcctacaacctgccgcacaggctattttctcacctctgtggatggaaactgcatccttccatatgctcagtccaaaaatctttgagttttctttgactgctgatctttccttcacaccctatagctgtttagtcaagaattcacattatgctgagcatcaggtgtgctccttaatccacaccatccttttcccccagtttataaaacttgtaaagtcattctcctgataaagacaataggatttccatgaaattgcacaatttttatccttcctggatacatgactcatgtaagagctctgctattgtttgctaccatttccccctatttttatttcatacctgtttgacctgcattctttcccataagccaggcacttcagctcaggtgtgctttcctaatcatagaattagcaatagcagccttgctaacaacttcttcctggccccaccaccaggcaaatgtcacaggatttaataggtaaagaatcgtaggatcgctgagcatggtggctcatgcctgtaatccaggtctttgggaggctgaggtgggtggatcacttgaggtcagagtttgagaccagcctgaccaacatggagaaaccccgtctctactaaaaatacaaaattagccaggcatggtgacgcatgcctgtaatcccagctacttgagaggctgaggcaggaatattgcttgaatctgcgaggcggaggttgcagtgagcctagattgcgccactgcactccagcctgggcaacaagaactaaactccatttcaaaaaaaaaaaaaaaaaaaagaatcataggatcgtgcctattactcggttttataaaatgaattgttttcccctgaattcatatgttgaaagcttaacccccaacttgactgtatttagagatagagtctttaaggaggtaattaaggttaattaggccatacagttggggtcctaatctggtcagaatggtgtccatataagaagaggaagggcatcaaagaatctgtctctttctccacacaggcacagaggaaaggctatgggagcacaaagcaagaaagtggacttctgcaagccaggaagaaaggcctccccagaaaccaactctgtgagcacatcgatctttgacttttggcctccagaatattgagaaaataaaagtctgttgttaaaccacccaacctatggtatctttctatggcagcctgagctgactaatacccttggtaggtgggtggcagtcaccttactgggctacatgatgtgaagttaaagtaactttagcaataggcaccatgtaatttcattgtatagatattatgtcttttgcactgatattgcttttttagttgtatgtatattgatgcctgggcctagcattacaagaccagtcaaaatgggaagaaagaaaagaaggtgggaaagataccaagttccataattgcatcctctacccacatccagttcttagaatcttttctgctggaggctgcaccttgtgtacactcaaattcaatctgagcacacaatcatttaaacaaccaaggcaacttttccaattttcagcatcacgcgcttgaggaaacaagtatttcatcactaatttaatattcattgagataattgttctcaggttgatgaaaaatgtggtgtatccatttactgttgtcttcttctgggtgaagaatgttgcctttactctctagctcacatttgaccagaaactggagtcccagcaaatcttagtagccacttaggaagcctattttaagatattcccaatctcaaacttgttctaagactagtatgcttattgaggagaaagagcttcatgacaaaaattcaactagagctgtgggtgacagttgtgtgtttcagtgctggtctgggcccaggtttcccatgagcacctaatgaataggctcatttgcagagatcgtcaaggtgttcactatgtctctctcacagcctcaaaagaagtgatcggctaaaagaatttgtgtagtatcctgaagggaaattagtccagaaatagaggacaagataaggattttataaaacagacatgtgattcaacagttgtttaagatgtagaaagctgcaagagacagttgttcccactctaatgacaagaaaaagctgtatggtctgcaaaatcatatgtgttttgatcccaccagagagctgaagttgcaaggcccctgagtcagctgaagtccaaagcatgagaaacccccctacagaaggacaaacagatgaagcagttcatctttaacagataatggaaggaaaagatggaagccataaatgttggttggagaaaaatcactgaagttttcatcatttctttagttttttttttttttttttttgatacggagtctcactgttgcccaggctggagtgcagtggcgcgatcttggctcactgcaggctgcaccccccggggttcacgccattctcctgcttcagcctccctagtagctgggactacaggtacccgccaccccgcccggctaattttttgtatttttagtagagacgcggtttcaccgtgttagccaggatggtctcgatctcctgacctcgtgaaccacccgcctcagcctcccaaagtgctgggattacaggcttcatcatttcttaaaggccaagtgtgaactattgtgacagcttagaatctctgagagtcccagacacatagcctgttttgcccatttactgggtctttcctcccacgtacttagtgctgataagacacatgtagcagggaaagagaatttctcgagcttgccacagtggtgtaggcatataagtcatgaatgcatgatagagcaccaccagagcacaggcacaaaacgtggttgcttctctcacataaaacaaaaggcatctaccactgatgttggagctagaaacctgtccaacccttgcccccaggtataggccagctgctgaggcagagttagacacaaaagctgtctatactggacaaggggaggagacctgctcttgcccaagacttcccatcattgaaaggtagagttccaccactcccaggggatgtcataggaacactaggactcaggcacccatggcctgaggtttggtacacattcagtgctatcagtaatatgagttggtttcaatcgatcatttgagttggttgcagaccctttcctttagtgaggaaaaactgtgatgtgggtacaaagtttccacgtttaggaaagattggcccgtccttcaggatattatattgattggatttctctcaacctcctttagttgtgtttaccgttattaaaattcagtgacattcacttggatgaggtggtaataaaaacaagttgtgagaatttctagtgatttttgatcccaagccatgtatcactgttgggccttcatgtgtgtacttgaaaacaaaacatgtacaattgtcgcactggtttgaagattttaatggtgaaagcaacctaatcagtaatcagtactctatctagaaaccaatcttggaaatatgtgattatgctcttttaaaatagctgaaaagaaggccgggtgttctggctcattcctacaatcccagcactttgaggggccgagttgggcagatcactgaaggccaggagttcaaggccagaagcctggccaagatgatgaaaccctgtctttactaaaaacacaaaaatcagctgggggtggtggtgcacacctgtaattccagttactcaggaggctgaggcaggaaaatcccttgaacatgggactcgaaggtggaggttgcagtcagctgagatcctgctactgtaccccaacctaggtgacagagggagattctgtctcaaaataaataaataaataaaatagctgaaaagaaatgactctgtgtttattctcactttgttcttgttttgttgtatagtatttaaataaaagcagattatttatcctcatactgaatttccaaaactgatatttgcatttaacattttgttaaatgatggagagaaaatttaattgtcttactttgaaaagtttggcataggttctgtcacatttttgatgctttcaatcgcagtctgtcattagaatgctggcaactagttacatgcaaggagtatcctaaccactttaatacaatggtttgaagtgctgcaggcagtaactactggacaccaaatcacagtgtttttattggtgacatgttagagagaaatagaactttctgcagtacaaatgtcctattaacaaatccttgtgctattagcttacaggactttgactcctgggtctgaaaaaggcacctactcctgctaaatcttgaatattgacaccattcaatgcctcatcttcagaccctgaggaagacgacaatccaaatgaactgctttcatgagaaacagaacaagaaattgaaacaatttaatctctctagacccaacaatcccacctgcccccttttccacctcatgccccctcttcctctggacagaagagatgggcacatgacaatggtaaggccggagtctgagggataagtttagttcagagactttcttttctttctcttttcttttctttccttccttccttcctttttcctttctttctttcttttttttttttttttttttgcatttttggtagacacaatgtttcaccatattgcccaggctagactcaaactcctaagttcaagtgatccacccaccctggcctctcaaattcagagattttctataaattagacattacactcaggagcacactgatgcaaggccagcaactggccccgtgtatcagaataacagggttttctagagcgttcatctgatttttcatagaaaagtataaaaggtcatgaaaggtttttgaaactcttaccttatggtcaaactaattgtaattaaatttgtgtataaggttttattaaaattatctttaacattttaatacaccacacaaaggtaaaatttagttttctcttttgatcaaaatgtttgtgtaatattaataatagataaaatatttttgtttaccttttggctaaatgattgactattataaggtgacctgtgaccctattttgtgatatcaagtgtctcaaaactttgatatctggcaaactttctaagagtaaaatttctaaattcagccctttggacctcaaattaactttttggatattaggttcttgaagtccaagagagatatattaggcttcttaggcttatttgttatgtagaattatgcatgaagcattgtcaaatctgaggtggtgtttcacttcctttgggttctattgacacagatgtgttgttaatgtgtgttccaggattgtatgagattcctagagttctgatatgctgttggtaataattatgattattacgttaaattgttgtgtgccacagaaccaaccaaattcccttgtcaactgtatctttaactatggctgtcttaaggcttttgtcatccacaattgttgttttgctttgattcttctcaaaaagtgacttataatcagtcacagtccaggccttggttttttggggaagtccatgaaaaggactcttggatgcaggtttctgataactctggagatcgtgccattaactaaagagaaaatttccagggcactaacagaaaggctgatgtgttcatagagattgctagcccagtatgaagcaaagcaggagatgattgcatggattaaactaatggaggactgaaataagtttttatggcctttgtttgtttgtttgtttgaaacatggtttattcttcagagtctggagaacttttttccttttgagctatttatagcctgaaacaattgagtagaatagtcttctaaacagaatttgaggcatatttttctctctctgctgaatttctccagaatttgtaaactgaatattcttaattcatgacaatgtgtttatttgcataagttcaataagattctgttttcttttataacctgacacaggtggaggaattggtaattttcccagggctttgcctgaaatgtcattgtgaaatgttccagcaaagcccatttaggagagcctatgtgaacaatgattcttgctgcactttgtgtgggtaatcaggccaagtatatgggactgaagcttcttttgcaggtaggttggtcctgctgtgttttatcttagtggaaatggggaactggagagaggaaggttgtgtttcaggagaaaccatggtattagatgaatgtttgattcctgggtggccatgcggtcacccatggtgtggagctgcccaggatgccccttctccacatgacacagccagaaagatggatgaccagattccccatgattgaggaactgacaaatagaaagtggggactgaaatcgatgcaatagtcccacagacagtgtttttggatagatgtagaaatggacccttctagtcttaaagcttgaaacttacatttgttttatctgagttcattcctcaggaaaggaccctcagcctctcaaaaagcatcatagacctgaaactcagcagatcacagcatccagacaatgagatgccagacccctcactcatcataagtgcttcctcacccctccagttcctcttttcctactcacagttacgtttcttccctgctacataaactcctcactttagttgatcagggagattgatttgagactgatctcccgtctcctcagctgcagcacacagttaaagccttcttccttggcaatactcaatgtctcaatgattggctttctgtgagctgagccgcgggcctagaccaaacacctgggctttcagtaacaatacatgtacacttttaaagcctgcaattaatgggtcatgagatattgagaaattggaatgacatcaacttggccaattctgagaaaatacactgtgcttaaatgtcagggccccgcctcctgaccttgacagtatatggttgattttgagtcatagcaggtgagtatggcctggtttgagtgttttatagaaatatataatatggctgattgcatttattttaaatccaaaaaatttccatttctggtgagcaaattttgttaaaaccaaccaaacaaacaaacatagaagtatatgaacaagacaatgaatgattccctgcctcccaatctcatttgattgctgtcttctgttatatactacagggaagaagggggcaaggcacccaggatgtcccatgtcctgttttgacaatcatctggcctccttgggcaaacagaaaagaaggaaagcatcaagaaaataacagaaattttgcagaaatttcatctccggtctgggcgcagtggctcacacctgtaatcccagcactttgggaggccaaggtgggcaaatcacttgaggtcaagagttcaataccagcctggccaacatggcaaaacctcatctctactaaatatacaaaatttaaccaggcatggtggcccacgcttgtaatcccagctactggggattacaatcacttgaacccagcagatggaggtggcagtgaggagagatcacccactgccactgcactgcactccagcctgagcaacagaaggaaactctgtctcaatggaaagaaagaaagaaagaaagaaagaaagaaagaaagaaagaaagaaagaaagaaagaaaggaaggaaggaagggaaggaaggaagaaaagaaagaaagaaagaaagaaagaaagaaagaaagaaagaaagaaagaaagaaagaaagaaggaaggaaggaaagaaagaaagggagagagagagagaaaagaaaagaaaagaggaagaaacgaagaaaggaagaaagaaatttcacctaggcacaggaaactctatgacagaggcttcaggggctcttctctggccctaaactcgcagtggatttttgcctcattttccgaggtgcaaatgaaatgatagaagtcgatcaaaggagagggcagagagaaagcaagaaggatggctccttcctgcaggtccaccttcctggagtgttgcttgtgggataatagaaatgccttgacatgggtgggtgggaactattgctacttattaggaattcagacgcttctggcaaattcgcattgtgaggttccatggtgtaatggtaagcactctggactctgaatccagcgatccgagttcgagtctcggtggaacctttctgtttaattaggaaggcaatgccgtgttttactccctaaatggaatggggattctgctgacgttcagaagctctgcgctgcgggcctccgtgtcccttctgctcccgctgtctgagcctcgggatgcacgccgctctcctcatcccctcttcggtgttcggggtcccagaaaccgggttctcacagtggcccggaccacagggaaatcgccgaatcatccattcggggtcaaagagcctggaggatcccctttcagggccagcctcctggcacccagcaatcggaggcccggactcgccccgccagggacccagcgacccagcaagtcctcaccccctctcagggcgaccctaggcctcggggagaggtttccactaaaaaggctgccacctctcgatcctagaccccgagattcctttcacccgggaaatctcttaatcgcatcctttgtcattttggtaagtaaacggtggcgtgagaaattttgatggggttagctcagtcactggagattgtgtctcagtttaggatcggtggttggagacctaacttgggagtagcacttttttattcgcatggcccatccaattccgaatgttaatttattctgttcttcatattcagatttttatgccgaatttctagctcctacgtctctattgcgggccctaaaagtcgctgtttcactaagctttggaacctgactccgggaaatttcattctttcctcccaagatctcagccggaaagagagatccgcgcgggctgggagcgcgggttctgttcctcggccgccccggctgaactcccgcaggaccacggggaagaggagcctgagcagctctgaggggccagtctctgacggtggggctccccctcgtcccgtcaggaccctgccccaaggagaagacgccttagaacgctaccagagttaaaaatgttttctcctgcgcttcagagcacttgggatgaggttcctgatgggtcttgggagtgaactaagatgtcactccaggcgctcaggaccatcgctctgattttcatattttggggctgagagcggttacgaaggactgaaaaacaccgcagtctttgaggggctcagtttggaggacgagctgggggaggggggcggtgagaagacgccttcttggctccttggagtggactggcaggtaaggaaaaataaactccgtttccccttgcaggctacactgcagggcctgggatggacaattggacagtcaaagagtaacaatatttatgtagaggttggctgcatgcattaaaaattgttatccctacagataagtgtaggaagggaccacggcactgcggttcaccaccagctttgcagcatatgtaactatgaaaacagtgtatagtgcataaaaaattcattcctgttcacaaataattgatcacaaccagttacaggtttctttgttccttctccacttccactgcttcacttgactagccttacaggaaaaaaaaaaatcatttgtaaatatgatattgtttcagttgatcctcagcccgcccgttccccaccccctgaaagtagctggaataacaggtgtgctaatttttgtatttttagtagagacagggttacgccattttggccaggcagctctcgaacttaagaactcaggtgatccgcctgcctgggcctccctgaacctctctgctgggattacaggcatgagccaccccacttggccatcatttgtattttgaatttaaatattttgtagtcatcactcttcaaagattctgggttttgttgcatgtgcatgatgggattcaggacatgctactccaaagtataacatcttggggtattgaatattttatgctaaaggaatatgagtaaaccacagaagcaggaaggtcactgtcaccctccccctgcccttcttccctgaagtcgattgtaagactcttatgtgagaggtgccctctctgtacccagaggaaaggtgcatcctggagtgtgaagacacagggacacagagaagagcctgaacacagaggcctggccacattttccccagtttgttactgttagatcatacttttattgtcttatcatacttctccatgactatccattcttcaataaaactactgttaaaaaacaaataaacaaaaaactgaggtttagctgtttccatgggccttcattttctttggaaggcgctcctgtcacataaaacttacattaaacaaatacatatgttcttctcttattagtctgtgttttgctgtgagggtctcagcagtgaacctaggctgggtgaggaaaagtcatatttcctccccgacatgtacaaatgtcttccactgtaaagctataaaaattttattggggcagatgtgaagcaaaaaattgaatcattattcccctttggatgagttgaacagatgagctaataaactcccagttccccccagatagaaatacttctctagctcattccccgaagctccttgagggtcaaacttgttggagattgaggggccttcctgggatctcccagcccaggaggttgctgctggtgagaggattgctgcagtctccctgggagggtgcatggtcactggaaagtatcactgctataacttcaatacaaccggttttcatcacatctgctctttgtgcagtgttacaggcaaaatacaagagctaacatgcacatgagtaacacatgcacatcatcaactgtgcctgcaacccaaagtgctacatgtcacacacagttgatgagtgtgcgtatgtttactcatttagtccttacctcaggcagaggtcacgccatcaccttcatcttccatatgagaaaactgagatgcacaaagatgttaagtgacctgcccagggtcactcagccagcaaaggaggatttgaaagtgggaatttgaagtgaaggcagcctgtctccagaagacattctcagaaccactgtgtttatactgctcctaacaaaaccagccttgcaaaaattatgacagtgagaaaaacctgacataggaaaactatgactgtgaaagaaatctgacctaactgactgcatcttgcttctaacctctgagctgcccttgtccattcctgggcataggccaggctaactatgagaggagtttagttccaagtctaagtctgaaacagagatgattgcccattcctgagacaaaccccttcctttcttggggatcagacctccttagcaaagctaacagatcaggtacgagattggaaattatggctcaggagccatgcagccagaagccacatgattcctaagctccccaactgtgccttatataacagtattagtgtcaaacctaagatttgacagggtgttcaaggtatttttcagaccctgccttatgatggactagctggcacacccagaccggtaaactgtctcatcttgtcctgtggccctcacccagggactgactcagtgccataaacaagctctgacactgtgatttcatccccaacgcaaccaatcagctttgcccatttcctagccccctgcctgccaaactatccaaaaaaaaaaaaaaaaaaccctagtctccgaatttggggggaggcagatttgagtaataataaacccctgtcctggtccctcagctgcctttgcatttattaaattttttctctattgtagaaagcctgctgtgctcagctccattggcttttctgggcaaccagcaagataaacctagcaggcaattacactaataaaagaaaaacacaaatggtaagcatgcttgaaaagaaatgtaagtctgtatatttcttttgaagaaacacaaaaggaggaggaatgataagataggcaatacactgtcctaaatattttcatgattctcctgcctcccgcatttccttcttatcccaataactgctccccagaaaccttcaacttaaacatggtcctgccagaactgggtttgtccttccctttacattttcctctcacctgccccacaccccttccatatctaatctgtcctttcacttccaagtcattgagtttttccatttaaaaatatgaaagatacggaaagaagaagataaccagttatccatattagcaaagtactgttcacatatgtacatatttttcttccaaacaattttaaagttactctcatttaaaaaaaaattatacatgcttagcatagaccataccaccaatacagaaaaagtacagatacataaaatttctgatcacgttaagttcaaaataatttttgttaacattagggcaacactcattgagtcatgttcttctggtatatctacagagacagtgtatattttaggtagactggcccccgccccatgcacccataaaagaaaaaatagaacaataaagaaagctatatatatatatatatatatatatatatatatatatgagttatatattttatatatatatatccacatacatatatgcttttgtaaaattgagcttagactgtatttttattttacaaatattccatttaatagtgcatgaatttaactgaagacagagacagaaacacaaatgaaggaattcctgaactctcaatcacatttagagagacattttctaaaggaatcttctaaagctaaacgtacattaaattaagtagaaggcattatgatttgcagtggttttccttttttttgttttttgttttgttttgttttgttttgttttgttttttgagaccgagtcttctctgtcgcccaggctggagtgcagtggcacgatctcggctcactgcaacctctgcctcccaggttcaagcaattctcctgcctcagcctcccaagtagctgggactacaggtgtgcaccaccacatccagctaatttttgtatttttagtagagatggggtttcactatgttggctaggatggtctcgatctcttgccctcgcaatccgtctgcctcggcctcccaaagagctgggattacaggcgtaggccactgcacccggccttctttttcttttcttttctttttttttttttttagcatggcatcactcactctgtcacccagactggagtgtggtggcgccagctcagcttactgcaacttccacctcccaggttcaagagattctcctgccttagcctcccaagtagctgggattacaggcgcccgccaccacgcccagctaatttttttttttgtatttttagtagagatgaggtttcaccatgttggcccgctggtttcaaactccttacctcaggtgatccgcctgcctcagcctcccagagtgctaggattacaggcgtgagccaccgcacccagcctgcagcctgtagtggttttcttattactttttacaatcaaattgattaaggcattggttgaatatggtacaatgcatccatttcaagtttgatgacatgtctattactccaaaatgtccttttgtaccctttgtagtcagtcccctcgactccctgaacccagcaatcaatgatgtagtttctgtcactatacaggttagtttcacctgttctagaaattcagcttgatggcgccacagaggatgcactcttttcatcactcagcatgaggtttttgagattcaccaatgctatctcatgtttccataatttgtcccatcttcccctggaagaatatatcacaataggtccattcacctcttgatgcatatgaacggtttccagtttcgggactattgtaaacaaagctgctaagaacaagttctttttgtgaatatatgttttgtaaattccatttgtcattctttagtattaacttattttgtaaaaggatgtcaccttcacaagtgcaaaattcattcaaatgttttttgaaaaaagttgaggcctgaagcagcagtctacacaatttcctttcttatatttcataattaaggggaagaaactttatctgggatattatttcctatcagcaaatccttaatgtaagccacacacgatgctagctgtactattagactatcttctgtaatctgtgcaataactccaagaagtacttcatattattattttcctgtaacactttccaacttgaagcctagcaaattgaaggacctggcccaaggtcaaacagaaggcaaggggcagcgccaggactggaagaaggccttcccaaaggcagacagaagctcatgtctttgtcagaacctcggtatttctgatgcgcctggaagccaatatccaagccgttctcagccaccggattggtgggtccttttgctcagaaactcctcgatgaggaatcccaagcatacgttagtgatgacggtcccgaaacaagggacatttcttaaacattctaaaaacccttttgctcatcggtaacgcaatgaaagttgttttcggtcttgcttcatatattttatatttgagcaaggcaatgtccgctgttggggttagaagtaaatggctcgtcttcatcaaactagatcagtccgtaagaagtacggcttccactcgcagtgtcctgaacactcgctgggcgtcctgtgcgttctagccggttttctttggagccgcgggtttctgcaccgcgcccgggttgggatggcagaggcttctcgggacgtgcggatctatgagtgccgtccccagggtagccaccaggggacgccataggccttccttccgtggtcctctttgcctttttcgtttgggccaggtagtttctattgaccaggacattagagatcagaagtgggtggggtcagaaaacacaccctgggagaggctggcgaaatgcccagaacctccatcactaggcctggggttttcttctgtagtggaattcttgtgctcatgtagtgcagggacaaaaccaattagatacttctgggagttaaaaagagatgaatttacaatgccatttgagaaggggtattaaggaaacgtccgaatttgccagggtactgatgcgtgtctggtgcaaaacgcaggttgagagagagctaagtacttcctgtccatgaaggtgataagcgagggcctgaagagggacgggggaggacactggcgccagagatagaaagaggcggcttgggggtgggaagcatgggtcggggtgctatttagaaagttgcctggcaatggatgtgggatgtggaagcgagacatcaaacaagaagctgtcacttaaatgaaatctgaagaaagactagatatgtaaacggcaggagatagtggatccggctcctcataaaatttcccgctttatatttcagggaggatcgcagcgcattttcgccaagacaggtgagactgcggttctgacctgcgtgtctcgggatgaattgcgttagggcacctgggcgccggtagaccccttcccctccgcaaagtaagcgtgttatgtctacaacccaacgggaacactaagagccccaaaggccctgatttcttcccaaagaacagcgcccgtctgcgtagtttgtacctggctctaccaagtgagaacacattccccgctagcacagaaatcctacaaactcctgagggggctgcgcttagaagcagaggctgtgtaaaaggtgattgggggctagggaaaaacaagaagatttttacagagcgtgagaccccaagagaatggagactatggaccaatctctgcaaaaagcagcctcatgttgaaaggaaggagctgtgcggccttcgcgctacttagcttgtgttaaacaggaacacaacgcctgacgcttatttctccggcaggaacgacggcgacatgttacttcctgtttccctgccatccggctataagaataacacaccaccaccaagattatacagcaaaaaaaagcgagaagtagacctttgcataccaactgctttttgcactggaaaattcaggggaaagcgcgaacgcagtcccccactaccacaaattacgcagtcgagtttcccacagttggggaaatcgcagaggtcaacacatccggagtgcaatggataagcctcgctctggaaaaaccactttcatgatcatactatctcccctgccaggtaagtgtgagttcacacatctccgccctgcgacagctccatacgcctcaacctttacagacacggtcacttgccccgcgcacccgcacccccacccccaccccgccccatgccacccggagccctcctagccctgacacacagctgggactctcacgtccaaccagcggtcctggacttgctcccaaagcaggagaaatccttcgtgggaagcagcagcccctaagctgcctcatctacgtaggaatcgccctatccgtgatgtcaccgacagcgcctttcccggtccccatctgctcttccgcccgaccctccgccactcagccgaccaacccgctgcgggagccggcggaggaagtgaagtctacctctatctcctttccctcccttccccacccctggtctctcccaaagaagtaggttcttagcctgtgatgccaaggacccctttggcggccagctggagcctgggcgctcttctttgagtaatggcttttaatgcgcaaactagaaagtttaggattacaaagaaaaccggttcttttcacatacggttatccttgtgatgtaccattccgcttgacagtggaagtcgttcaatatcagagagaaacagtatctatgaaactagagaggctgctcagatgactgcaaaccagccatccttacttgttttatcactaggaatattataaagacggctgtccagtttcatcaatcttgtagggtttttttcaaatacagcaatgtacaaaaatgtgctgccccagcagagcacactggacactcaggcatggtgctggagtcgttttgccatctcttcactgccttctctagaccttagcgcttacctcatgttaacactttatatgctgcaaagacagaaacaaagtcatccaaatgtggcaaaaatattttggggaaattttatttcaggtatttaactgattacttttaatatgtaggcaacaacaccaaactctgacaatactccgcagacttattaatggtttccacccccgtctctgcaaatctatcaggcaagtttttcccgccctttactttcatataaactgagtcatacactgtgtagtgagttttggggggagtgttactgcccaacaggttcaccttgcctgctgcctagacagagccaattttttgacacaggggaattgcaataaagagttatttaaacagagctggctgtgtgggagaccagacttttatttttactcaaatcagcctcctcaagcattccgggaccagtttttaaggataatttggtggatgggggccagtgagttgggagttctgattggtcaggtcagagatgaaatcacagggagctgaagctgtcgtcttgtcctgggtcagttcatgtgtgggggacacaagaccagatgagccaggttatcagtctagctggtgccagctgatccactgagtgcagggtcggcaaaatacctcaagcactgatcttaggttttccaataatgatgtgatctccaggaacaatttggggaggtttagaatcttgcagccagaggctacatgactcctaaaccataatttctaatctcgtggctaatttgttagtcctgcaaatgcagtctagtccccaggcaggaaaggggatattatcatctttgtttcacagctaaaccataaactaagttcctcccaaagttattttggtctgagcccaggaatgaacaaggacagcttggatgttagaaacaagatggaatcagatcagatctctttcaccgtgataattgtcccagttctaatttttcaaaggcagtttcagaagcagaggcataggtttgacttctttcactcagtcttatgtctatgaatttttcaccttattcatatggttatttgtttctgtgtgtcttactttgtatgaatatacattaacttatttattcatttgactgttgttgaacatgttgacctaaaagaaagaggctgaagcacaaaacataatatagagtttacttgagccaacatgaagacagctgcctggaagactcacacccaaggaaccttggatctgagctccctttggcttttgtcacaagcaggtttttaaggtcaaaagcagggacagacagtaggctgatagaaaggtgcctgtcaggaattctcattggtttacagaaataacattgattggtgattggctttatgttgttaagttataggctatggggtatagtgtttggtgtggcattattaggataatttacagcgacttgaggcgatatcaagcagtttcaacagatgaatacatagctcaaaaggaaggaatggaaaggggtttctctctcgatttaacatctctctgggcctgatcatttgaaagggctcacattcctcagataaaaatttttttaagtcctcctctccctctccctcgtctccctctccctcctctccctctccccacggtctccctctccctctctttccacggtctccccctgatgccgagccaaagctggactgtactgctgccatctcggctcactgcaacctccctgcctgattctcctgcctcagcctgctgagtgcctgcgattgcaggcgcgcgccgccacgcctgactggttttcgtatttttttggtggagacggggtttcgctgtgttggccgggctggtctccagctcctaaccacgagtgatccgccagcctcggcctcccgaggtgccgggatggcagacggagtcgcgttcactcagtgctcaatggtgcccaggctggagtgcagtggcgtgatctcggctcgctacaacctccacttcccagctgcctgccttggccccgcaaagtgccgagattgcagcctctgcccggccgccaccccgtctgggaagtgaggagcgtctctgcctggccgcccatcgtctgggatgtgaggagcctctctgcctggctgcccagtctggaaagtgaggagtgtctctgcccggccgccatcccatctaggaagtgaggagcgtctctgccaggccgcccatcttctgcgatgtggggagcgcctctgccctgccgccccgtctgggatgtgaggagcgtctctgcccggccgccccgtctgagaagtgaggagaccctctgcctggcaaccgccccgtctgagaagtgaggagcccctccgcccagcagccacaccctctgagaagtgaggagcccctccgcccggcagccactccgtctgggaagtgaggagcgtctctgcctggcagccaccccgtctgggagggaggtgggggtcagccccccgcccggccagccgccccgtccggaagggaggtgggggggttagcccccctcccggccagccgccccatccgggagggagtttggggggtcatccctctgcccggccagctgcccgtccgggagggaggtgggggggtcagccccccacccggccagccgccccgtccgggaggtgaggggcgcctctgcccggccgcccctactgggaagtgaggagcccctctgcccggccagccgccccgtccaggaaggatgtgggggggtcagccccgggcccggccagccgccccatccgggaggtgaggggcgcctatgcctggccgcccctactgggacgtgaggagcccctctgcccggccagccgccccgtccaggagggaggtgggggggtcagaccccgcccggccagccgccccatccgggaggtgaggggcgcctctgcccggccgcccctactgggaagagaggagcccctctgcccggccagccgccccatccgggagggaggtgggagggtcagccccccacccggccagccgccccatccgggagggaggtggggaggtcagccccccgcccggccagccgccctgtccgggagggaggcgggggtgtcagccccccgcccggccagccgccccgtccgggaggtgaggggcgcctctgcccggccgcccctactgggaattgaggagcccctctgcccggccaccaccccgtctgggaggtgtactcaacagctcattgagaacgggccatgatgacaatggccgttttgtggaatagaaaggggggtaaggtggggaaaagattgagaaatcggatggttgccatgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttgaatggattaagggtggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttatctgctgaccttccctccactattgtcctgtgaccctgccaaatccccctctgcgagaaacacccaagaatgatcaataaaaaaaaaaaaaaaaaaaaattttaaaaatctttcttcttgaaagcattgatgatcaaaagctcagtcaaggtgtccctctttgccagaaaggctcattcccagatagtcctatcccaggcaggggacagggaaggaaaggagccacctcaccaaggaatttttaagaatgaccacaagtccaattgaaagggcattacagccagacacggtgactcacacctgtaatcccagaacttcaggaggccaaggtgggtggattgcttgagtcgaggagttcgagaccagcctgggcaatatggcgaaaccccatctccacaaaaaatacacaaattagccaggtgtagtggcacacaccttagtcccagctactcaggaggctgaggtgggaggattgcttgagcctggaagttcaaggctgcactgagctaagatcacaccactgcactccagcccaggtgacagagtgagactcagtctcaataaaaaaaaaaaaaaaaaaaaaaacagaaagaaaagaaagaaaaagggcatcatagaatggcaaaaaaaaaaaaaaaagagagagagagagagagagaggcctcagttaagtctatagctgttgtcacctgttgaatcatctctagtcttcagaataccatgaaattagttttctcagaagtaaaacgatgagaaatacataacaataatgacattgcacttcatcattccatgctcttagacatttatagggccatggatggtgatcttttcaagagacaaaaataaatgctggtgcagaacaggtaagtgcgctataatttgagtacatcagcttttgagcatttaaatcatgcatcagaaatttagagcaagagggcaggttggatcctgatagcaggagtgtttttcttttaactttccagtagcatcatggtgtttaccactgtcatttcagagtgacgtgacaattttttgtttgattttgtactttttatttttattataattactttttgagacagggactcactctgtctcccaggctggagttcagtgcaagatcacagctcagtacagccttgacctcttgacctccaaggctcaatggctcagcctcctaagcagctgggattacaggcacacaccaccacacccagcttatttatttattttttgagacagggtctcactctgttgtccaggctggagtgcagtggcatcatcagggttcactgcaggcttgaactcctgagctcaagtcatcctctcacctcatgctcctcagtagctggactacaggtgggcaccaccacacccagctaatttgtatatattttacagagtcagtgtttcaccattttgcccaggctagtctcaaacccctgggctccagtgatcctcctgccttggcctcccagagtgctgggattacaggccgttattttgacaatacgattatgatgggttaaactgagatgtgaggcaggaaggttagggtgagtcacatagattcgataagcaggttttgcttgatatgaccctgagttgcatcgtgagtgcaatcaggaggaatacaggtgaaatttagcacaggatgtaccaacgggccattatggccaaaagtggttggtggtttaaggtggcaaacccagcaccttgttaaatttcccacagtgcaatggtttgtgagattctgatcagagaattatccctccctgctataatcaaattaattagggacagtgaaacagaaatctgatcataggcattttgctatgtaggtatgtatatgtatatacacatacacgcaataggactagtgtgtcatatcttaagagaatacacatataggatgattttaccaaaaccaccaagagaggacccctacaacttaagggagccctagtggtgtattattccagtcaacagaaaaagagactcaggtgcagtgagcactggaactgtattgttgatacaggccagtatcttgggcaaaagcggactacaacagatgtcagctacttgccatctcggtcaggaagactgagttacctttaagtgaaaatctccactaacagatgtccactctggcagtgctgccttttacaaaagaaacatgaatccgtgtgtcaacgcccttaagtttactggcacagattgttcagtaatacctgttgtgagttgggtacattggcccatgcctgtggtcccaactatttggaagattgaggcagaaggatggcttaagcccaagagttcaaatctacagtgagtcatgattgtgccactgcattctggcttggggaacagagtgagatcccatctcaaaaaaataacataaaataataatacctgatgcggtcccttctaacagtcttgggaggagtattttatttgatgttgtttccagtaaacaacaacatctccaggttataggccaagatttttgatattttcatctcccaagaattcattatgaaaggaatcctgtgttaatgtagagtttttagtaagttttgtgagatcttagcagtaatggagaatgtcacctttgagaagtgcatattcataagtgtcttcacctaaccactgcatgggtcttcctgttattatttcaaagagagagagtgtggacattttccagaactagtgggagatccttggccaagaaaggttaaaaacttctgttagctttgcctatggagtttttattgtatcatcagtgcattccatcagcccagaggattaggagtgataggcacaatggaattgttgggacatagacaaaactgtacaaatggatccaattacctgaccgatgaagtgtgttccttggttgctatggaattcagatggcactctccatgaagaattaccttttctaatcacaatctactaacctactacttgggctgtggctcatcggcatggaaatgctcaccccagtgagcacatacaaattagcaccagaaggtatctgtaaccctcagatggagacagctggataaagtctaagtgctatgtctcaaagggtcctaaaggtaaaatgttcctgtgacccatgaagtggttttccagggttatgtttgggacagacagtatagcaaaaataaaccttttctactatcataggcaatgattttcaataccattgctttccccatgctaacattttgtctgaattccaataagtcagcttatgaagtactgtaaaaagggtgactgaagcctaaagggtggatcagtgtatcattgggcccataccatatgcctgtttctggaagaaacttgtttcctttatccttccagagatccctctcctgcttgggagctcccacttatgcttcttcttctgttttttttttttttttttttttttgagccagagtctcggtctgtcacccaggctgtagtgcagtggtgcaatctctgctcactgcaacctctgcctcccaggttcaagtgattctcatgcctctgcctcccaagtagcagggattataggcatgtgtcaccacaccggctaatttttgtatttttagtagagacagggtttcaccatgttggccaggctggtctcaaactcctgacctcaggtgatctgcccgcctcggcctcccaaagtgctgggattacaggcatgagccaccatgctcagcccacttgtacttctaaagaagtcttcaatgggtcataagtcagcaaggtcattttgagaagttctgtgtctgatgtcaccttcagagctgcattcttagctgcagcgtcagcaaaatggttgcccttgctctccggaatatctaattttgaatgaccaggaactcctttgatgatggccaaagattcaggttttcaaattgcttctaagaggtcagagacttactggtcatttttcatggcttgaactgatgaaatcagaaacctatgttgcttctaaagcattccaaaatcatcacctactccaaatgcacctctgctgccagtgtaaatgttaggctgaggtgagaggattgactgagcccaggagttcatttaggtccagcctggaaaacacagcgagacctcatctctagaaaaaaaacaaagaattagctgggcattgtggcacgcacctcagctacttgggaggctgaggtgggaggattgctagagctgagagattgaggctgtggtgggccatgatggagccactgcactctagcctgggtgacagagtgagaatctgtcacaaacaatcaataaataaatctcaaccgtttaaaatatcaatgacagatttgcttggccttttaagtgcattgctgaattctccaatctacatttttaggaacaacctggggaatggcaacatggaggtatttggccaaaatgcagaccctttcattgtctgcttcagtctgtttttaagaatcctctaaaggattattccaatttgcccttttcaaccatttaatggccctgccttcttaccccagcatgtgaattaattgataaagatcagaatgtccaggctcaaaagtttgggcaattaagtcaaattacctcccaaacactataggatcttggaggctgctttagaattagaaggggaaaatgtatttaaatttcaatcagggaaatcttttttttttttttttttttttgatatagagtcctgctctgtcacccaggctggagtgcaatggtgcaatcttggctcactgcaacctccatttcccaagttcaagtgattctcctgcctcagcatcctgagtagctgggattacagtcatgtgccaccatgaccggctaatttttgtatttttagtatagatggggtttcaccatgttgtccaggctggtcttgaactcctgaactcatgatctgcccacctagtcctcccaaactgctgggataacaggcgtgagccactgcacccggcccagggaagtcttttatgatattcttaattcacattttggtgaagcagtatacagaatggtaggctcccttcttcctgtggattttaccttgaaaggggctgtcagaacagaagtttcagggaagggaccagagccctggggactttccttaggtgatggtgatggaagaagaggcaaggcaggaaaggagggctcaggtaagggagactatgcaggtacaggggcaggagaagaaggagcagttgggggcgaaagagacaaagcctcctcaatatttctcagttcagaaaacatgtcagtttagctccttcagcttacttcctcactggagataattttctcagttcttttagaaatttctaggtataattggaagtaagtctcccatttaatttggttctaaaaccaaatttttccaattgtgcacactaataaattattttaagcatttcaaaatatccccattttcttcattctgcttatgatttttcctggttaggtgggtccagtttcttggatatttacaagagaatgcctcataagtgttatacataaacccagctgatgtttctaaaggtggttgtttcttcgcagtgtgctaaattttgaagcttgatttcccataattcaggagcttttcagatgaccaaggcctgcgatgtgttttgggtcacagtgtggtgcttatgaagtcactcctacagataacaccggagttgtgtattgctgtctcagtggttcccactgtttctaaccaccaggtggccacagagtgcatgtgctatgagggacccatcccacatatgccctcccagaagagcaggaaagggggttcataaagatgttcttctgatagggagtgccctatgaggccaccttcacatggtgagtaatgaccccgacacctctgcaacatccccgatcacttggagcacctgaatggatcagcgggagcagatcacttcttttcttcagggcaagggaacacacctccgtgcactttccagttaagaacaggaactagtcacaaatgaaaagctaagtccgaatgttcaaaacaacatgctacataaaacgaaaccaccagagcatacctgccaataccttggcccagatcttcctgctgaggaacagaggcagaaaaggcagaagctctctggggagctctttgcctgactgtgacccaaactttctgtcctgacgcagaggtggaaaaggcagttatttccccctgaaactcaaatctcttactcacagggtaaagacagaaaacctccgttctagaaagggagagctggaaaggacactcaagcaaactccaggccttcaaccaaagagtgggaaggtccagatttcaggaggattcaccacttactactgcccaactctttctctcagagtcagaactcaagggcttcagatctggccaggcacccagtccaggaggaatgtggtgtgatctgagagatgaaaatacatgcccccttagagactaaggcagactcgaaagttaaggaaacaaaagttagctacttgtccagggttcagggctcatctggcatggcaacttcctgaattcctatggctacaggaaaaaccacactcttgctaaactccttaacaatagaactagcaagcaaattgtcaaaaccttcccagcccttctcaactggatttacaacccagatcactagacctctgatgggacagaagagtggccttccattctctcctgataagcaactgcggatatcaagccagtttcagccatgttacagggactgcacacaaaccgacttggtgtccagcagttcaccttttgacataaaaagccaatttccaccttattttaatgctaaaatcccttcccaatgtgaagatggggtgcatgttacatatatgtttaccctttgcacatgagctcaatacccctcagaaatggcgtttctccaaacctgctgaatatgtataactccattgtgtgatacacaccctgtgaggcactaaaaccaaactgccctctctctctctctgaagagaaagcaccttttcaaagacacacaccagagactgtctcttcctggactgcaaactgatctcaccaatgaaattcttactactatgtagccaccctggaggcctttgagaggatagtcagatggtcagagatgagttgctctgaatcctgctcccagggccaaaaacgtcaacctagaaggaaggggcttaaacacaaaatatgatttaaagagtttatttgagccaatgtgaggatagttgcctggaaggctgagacccaagcaatcttggatatgggttctgtttggcctttgttacaagcaggtttgtaaagaccaaaaagggagacagggagttggctggtagaaagttgcttatcaggaactcccactggtttacagaaataacattgattagggattagctatacattgttcagctacagggagtgagagatggtgtccagtgcacgtgattaggttactttatagctaactgtggcaatagcaagcagtttcagtggatgaatacatagctcaaaagtagggaagtggccagtggcactggcccatgcctataattccaacactttgggaggccgaggtgggcagatcacctgaggttaggagtttgagaccagcctggccaacatgatgaaacactgtctctactaaatatacagaaaaaaaaaaaaaaaaaataggcaggcattgtggttcatgcctttagtcgcagcaactcaggaggctgtggcaggagaatcacttcaacccgactggaggaggttgcagtgggccaaaatcctgtcactgcactccagcctgggcaacagagtgagattccatctcaatacaataaattattttttaaaaaaatttaaaaagcagggaagtaggatgtggttggtgtttcattttaatgcctagctctaggcatggtaacttgaaagcgcccattttcctcacatgaaaaagttcttttctttcttttcttttctttttttttttttttttttggagacacactctcacttactgtgccacccatgctaaagtgaagtggcatgatctctgttcactgcaacctccacctccagggatcaagcgattctcatgcctcagcttcctgagtagctgggattagaggtgccagccaccatgcctggctaatttttgtattgtagtagagatggggtttcaccatgttggccaggctggtctcgaactcctgacctcagatgatccacccgcctcagcctcccaaagtgctgggattacaggtgtgagccaccatgcccagccaagaccattaatttaatctacagctaaatctattatattttcatgttacaaattcagcaagaaaagttttccctaatgaaacatcacatttaaagcataagtagttaaaaaaaaaaaaaaaagtaagagacagggtgttgctgtcatccaggggagagtgcactggtgcaaccacagctgacaaacctggaaattctgggctcaggctgtcctcccagctcagcctgaattttaactttttagatgtgacatcttgtcctgttgcccgggctggtctccaattccttgcctaaagcaatcctcccacctcagcctcctgatttgctgggattacaggtgtgagtcaaccagcctggcattgcaaaaaaaaaaaaaaaaaaaagtcaagaaattattcttattctttattttattttattttgagttgaggtcttactctgtcacccaggctagagtgcagtggtacaatgatagttcactgcagcctggatctcctgggctcaagtgatcctcctgcctcagcctcccaagcatctgggactacagacgtgagccactgtgctgactagtttttcttttaatcagctcattttttaaaatttgtagagacaggcgtctcaccatgttgcccaggctggtatcgaactcctggtttcaatccttcttccctcctcagctgcctaaagtgctaagactacaggtgtgagcaccacgccctgcttaattttcatattttaattttatatacgtaattattactgtccttaagataactggggcagtaatctccttaaagttttagagacttaatttatctgttcactccactggaagagtatgccaattggtttcataagaagatttatttataaatcagaaaaattctttccaccaaactaggggtcattcaaaagcaaataattgccttaagtaacatcatttaaggtgaaaacagatgcagtggtatctattaataatgcttctcagtgtgggaaacaaactgaaaaaatgaacatcattagatccttggaaaaccctcactgctgaaaatctgagtaattctgtgatacccttttgagtcttccaggacattctctttccggagcacataaaagtgagtaaatcatttttcatccattttcattaagagctgaacttccttgatgttctggagattattaaatttgatttgtggccaggcgcagtggcttatgcatgtaatcctagcactttgggaggccaaggtgggcagatcacttgagttcaggagtttgagaccagcctggccaacatggcaaaaacccatctctactaaaagtacaaaaattagccaggcatggtgttacatgtctgtaatcccagctactcaggaggctgatgcacaagagtcacttgaacccgggaggccaaggctgcagtgagccaagatcgtgccactgcactccagccttggtgacagagcgcgactctgtcttaagcaaaaaaaagtttttatttgtatagttgtgagaagtgcttatattgctgactccattgcttatttgtgatcatataaatctcttttcttctttctctagtgtgatttaaacttaatccttaaagaacatgtatttcagctggttagagttttttagctagtagaaacctgagtatatgaatcaaagaaaactgctccttacatgccacagacttagttttctttctttctttctttctttctttctttctttctttctttctttctttctttctttctttctttctgtactaagatttattttaggtatagtaatttgttaaagccaagagctcctatggaatgaagttagatgggaggggggcattgagtagtaaggtcatccttataatagagatgccactcttgcagatattgacagctattgggcccaaaaaattgtaaccaaatgttggaaagacaagatatgagcaacttctgattgctgcagtctcaaatatcaagaaataccgttatcctcaggacaatgaatacacaatcaaaaaagactcacagactagattagctgtcatgtatcatcaaacagggactggatccttgtcaaacaccacccaacagagattgtccccagaaattcacttcataacatcaaaaccagaaacccacattgatgccactgatggcagaaatcagtgatgcaaaaatgagagagagagaaagagagagagatagaggaaggatttgtccaattacaatgcttagtatataaaagcaaatgagatcaatttttgctcatgaacacagaagaactgagggaacaagagccaatagctctaaggatccaagtctgcaccaggggcctgcaggattctgttggctcccatgatgggtctcagatgggctaatttttatggacatagcctctgaaaaaaattagtcaagaaataatatacagacacttatctgcatgcccattctccattaatatagaagggaaactggcattagatggttttcatcaaataaaagtaaaatcaagatttataaataaaagaggaaagaggagaaaaaaatgtctgggaccattgtgattttgctccctttggataagtgacttggcagaaggctgtcaaagaggtcactgtgacctgtcttctctggaccaatgtgacttggtcaccacaggaaacaattacaggctgggcacagtggcttatgcctataataccaacactttgggaggctgaggtgggcggaccacttgagctcacgagttggagagcagcctgggcaacatgatgaaactctgtcttggagagcagcctgggcaacatgatgaaactctgtctgtacaaaaaatacaaaatttagccgggcatggtggtccatgctagtagtcccagctactcaggaggctgaggtgggaggatcccctgagcccagggaggtcgaggctgcagtgagccatgattacaccactgcactccagcctgggtgacagagtaagaccatgtctcaaaatacataaattaaatttgaaaaagaaacaaggccaggcacagtggctcatgcatataaccccagtactctgggaggccaagatgggagtatcacttgagctcaggagttcgagaccagcctgggcaacatagtgagacctcatctctaaaaactacatacatatatatattaataaatatgtataataaaatataatatataatcaaatatatacatattatacataatatataattgtatatatttactttcagataattataataaaatatgtatatattttattatatatacaataaaataaaaaagaaacaattacagatgttggaggagtttaaaatatctcagccaggtgcagtggttcaggctggtaatcccagcactttgggagactgaggcaagaggatcacttgagcccaggaggctgaggcttacagtaaactatgaccataccactgcactgcaacctgggcaacagaaaaagaccctatctcaaaaagtaaaatgtcttagaagtttagctgtccatcctatgcaactgaatacctgtgtgtgatgtccaccatgtcctcctgttgtacctcccccttacttaagccaggaaggcacttgtcccgttattagaatatcattggcacatggccaggcgtgctggctcatgactgtaataccagcatgttgggaggctggtcaggagtttgagaccagcctggccaacatgatgaaaccttgtctctactaaaaatacaaaaattagccaggtgtgatggtacaggcttgtaagctgagatcactacaatgcactccagcctgggcaacagagcaagactgtgtctcaaaaaaaaaaaaaaaaaaagaaagaaaataatattatgggcacatatatagaaagtttgttaagccgggtacggtggttcacacctgaaatcccagcactttgggaagccaaggcaggcgaatctcctgagcccagaagttggggttcctggggccaacttgggcaacattgcaagaccctatctaaaaaaaaaagaaagaaaaagaagtaggatttgatggtgcacatctgtagttctagctattctggaggatcactagagccggggtggcagggatgggcggtgagtttgcagtgagctgagatcacgccactgcactccatcctgggtgacagagcgacacgtagtctcaaaaaaaaagggagggggggggagaaaatctgttgtgtcggcaagtaaatgaagaaagggacgttattagagttgagaaataaattggaatatgatttggtacctttcccacagaagataagtttgctaaatgtgctgaaattagaagcattatataagacccggtgcagtggctcatgcttgtaatcctagcactttgggagacctcggaggtgcctgagcccaggagtttggggaccagcctgggcaatataatgaaatcctttctctacaaaaatacaaaagttagctaggcctttcggaagcgacaactgattgtgccacagagacacaaccctagtggcttaggactctgggaagatataatctcccccacttatctagtgatcgataatgcacgaacgctttaaaagctggagcaggcggctgggcacggtggctcacacctgtaatcccagaactttgggaggccgaggcgggcggatcacgaggtcagctgatcgagaccatcctcgccaacaaggtgaaccctccctctctactaaaatacaaaacattagccaggcagggtggcgtgcgcctgtattcccagctactcgggaggctgaggcaggggaatcgcctgaacctgggaggcagaggttgcagtgagccgagatcgccctactgcactccagcctggcgacagagcaagactctgtctcagaaaaaaaaaaaaaaaaaaatctggagcaggcttggagcagcagccgtccctcagtgggttctagccaccaacctttagattaacagccgaacgctctaaccgattgtgccacagagacacgtagtgtaccttcttctgggcgctataggaagggtgcactcaccaaacattccccaaccctcccatcctcagagcccaccagacagtaggactgtgcaaggccttggaaaaccggagagattacagcggtgaattgtgttggtctcgttggagacccgcaggttgggagattctggaaccaggacgaccttgcccctagcctgctttagaagcccccggaaacgccccggccccgacccggacctgagccacctgggggcctaagggaagctgaatgcccagtgggctcccgggatggctcttcccgttctttgcgcagccttcacccagtgagggagcctgtgcccaccctgcccagtcactttcgaggccgctgcggaacttccgctgccatcttccgatcctgtgtcccgcactgggacacagagcagggattgtggtgagggtggctcgtgggtcctctcgcggagagcagggtctggcacttaccagcgcgcacgactaggacttgttgaattaatccattgcccctttagcttttagtcctttgaagggccctgaaaatggaaatcatgaaatatttttccacggggaagttttgttttgcttttgagatagggtctcgcttggtcgcccaggctggagtgcagtggtgcaaacactgctcactgcagcttcgacctcccgggggccatcgtcgcctttagcttttagtctcttgaagaaccccaagaatagaaatcatgagatttttccatggggaagttattttttcaaagggtctattcacgttgatttctcagcatcccctggggcgggcaacgggcagggcctccagtgcacctttctgccgcggtggagccgcgggggctcagctgggcggtggtagggtcctgaggcagaagggcaggagcgggggaagggaaaagtaaaagcagggaaagaagccggggagcggtggaccagacatccagacctcccgaaggcctcttgcagaggcacaggctggatcttctggaggtgagaattgttttttgttgttgttgttgaagcagaatagggaggaactgaggggaaaattgagagagaacacggaatagctccaaacgcgaggacctataactcccaaacaataacatcttccagaagaactagacagaaaactaggcatctgggaaccctgaaatcccaggagaagtagcatcatcatgaccctctgtgttccttttggcaaaggacttgcttcgtttgtacaattgtttgtgtttgttaaataaataaaacccttttcatgtatctttgaaagtacattggctctattattttatggttacaaataatgctgcagtcatcattcttgtacacttctcattggccactggtgtatttctatagtgtagaggcctggagagcagttgctccagcatagtgtttacatggtttttatatcattccattttctttcctttcttggcttattatctataactgtttctttcatctggtccaccgctccctagcttcttttcctgcttttgctttttcagtgatggctttcgggtttccagaatacatcttcatcagtgccatcaagtgacattatacctccccttctggccattatgctagtgttgtcatgtaatttgattttagacatgttacaaaccccagaatccattattattgcttttgtttaatcggtcaaattattttaaaagatttatataataagaacatatatatttaactatgtacataccaatttccagtactctccatttctttatgtagatccagttttctgtctggtatccttatccttaggcctgggggactccttttgcatttcttgcagtgtgggttgctgagttctttcattttttgtatgtctttaaatgtcctcatttcagtcacattctggaaagatttttcatttcgacatagaattctaggaaaactttatttctttcagtactttaggatgttgccactttgtttttgtaaaactggcataaagtgggcttcctgtacttgttatacaatttttggaatgtgtatttaaattaaaaacattaaaatgggctggacgaggttgttcatgcctgtagtcccagcactttgggaggcgaacacaggaagatcaattgaggcccagagttggagaccagtgtgggcaagatagcaagaccctgtctctcatacacacacacacacacacacacacacacacacacacacacatacgtacatacattgtgaatgtcctagattcatcttaagttccaccaacagtgcacttaaagtaaaatgtgcccaacctgagggtcaaacctaactgctgatgtgcagtctgtgtttgtgagacattctcaacagcatttgctttccctagcatagcggttttcgtgttttcctcatacctgaatgtcttaagtgcaaaacctgtcagaaatcatttcctttgccaaaagattctaaaatactttttttttttttgagatcagctcactgcaacttccacttcccacgttcacaggattctcctgcctcagcctctggagtagctgggactacaggctgccgccaccatgcccggctaattcttttgtatttttagtagagatggggtttcactgtgttagccaggatggtctcggtctcctgacctcctgatccgcccgcctcagcctcccaaagtgctgggattacaggcgtgagccaccatgcatggccaaggtttgacttttatacactcttctgaaagggggggttggctagtttgaattgcgtcgcgggaatttgctggcgcaaaactcgctgggcaggctagagggcttacagaagcagaaagaaggcagttaatcaaactgacaggtcttgcaacgcaagcatagctggtgaccttgcagctgcactgaagggaagtcaggaacttacaaaaccagaaatggtaagggggaaagagaaggtagtaaaggcatttgttgttttttcctcttatccttatccgtgctaggggcggactgtgtagacagagtctctggaactcattccctggggctctgtcttttcagacagtgttatcaaggatctgctagggctctatctattgctggtcttggagtaagtcaagtactgtgaagctcagttatgcagttgagcttcacacattaggggaaacaacaagagaacagcacatctggagtgcaatggatgagcctcaaacttaggacgaatcactttggtaaccataggatttcccctgccagataagtggcagtccacatacctccgccctgccacagctccatatgcctcaccctttacacccacggttacttgccctgagaaccacccccgcctatccccaaccaccccaagcccttctagccctaacacacagctgggactctcacatccaccagcggtcctggacttgctcctacagcacggggaattctccctggcgaagcagcaaccctgtgctgcctcatctacacagaaatgccctatcggtgatgtcaccgacagtgcctttcccagtccccttctgttcttccgccccaccctctgccactcagccgaccaacacgctgccggagcaggcgggggaagtgacgtctgcctgtccctcctttccttcccgccttgtcctttggggaggtgcgccaagaccctgcatctagtctctcccaaagaggtgactacttaacctgtgccctgcggaggaaccttttggcggccagctggaagcctgtgcacccgtcttcaaataaaggcttttaattcgcagactagaacgtttaggattacaaagaaaactggttcctttcaaatctggttatgtttgtgaaatagcattccgcttaaaattggaagcccttcaatatcagggagaaatcatatctatgaaactagagaggcaaaccagccatccttactggttttaccagtagtagtgttataaagaaagttgtccaatttcatgaatcttgtaggtttggttttttgtttttcaaatacagtactgtacaaaaaggaagcggaatgtggttgcagtcttaatgtaatgcctctctgggcctgagaatttgaaaaggctcacactcctcataaaagttctcttcttcgccgggacggacagtggctcacgcctgtaatcccagcattttgggaggccgaggcgggtggatcacctgaggtcaggaattcgagacctgcctgactaacatggtgaaaccccgtctctactgcatgggaaatatttatgtatatgcaacaaaaggtatttgccaccacacatacatctccctgctcagctaaatatgtcatctaaagtgatgtgattatctagtacaaccttagccagtgaataaatagctttttattgagctgcaaaagaggctgcagtttcaacagcagtgtttttctttctttttctttcgaagacagtgtctggctctgtggcccaggctggagtgcagttgtgccagcacagctcactgcagcctcgaactcctgggcttaagtgatcctcctgcctcagccacagagtcactgggattacaggccagagccaccatgcctgattttcatcagcaatgtttcctgaggttacagaaagatttgtaatcctgggaggaaacagtcccctgaagcaaagtgttctcccccaaaaatgcaaagagctatcttcttgatagcgaggcagataattctcaggttttgccccacagaatctctatctaaaatagagcagtggtcatgactagtgaaaagtttgagggaactcacccaatgttgggtttcttcagaaatatatatatatttacataaatatatatttatatatatatataaatatatatccaaatatcctaaaagacactgcccttcatcattccatgctgttagacatttataggaccatggatggtgatctcctccagacaaaaataaatgctggtgcagaacaggtaagtgtactataatttgagtacatcagcttttgggcattttaaaccatgggtcagacatgttagagcaagggaccaggttgatagcaagagggagtgttttccttttaattttccaatagcaaagtgatgtttgccactgtcatttcagagtgatatgacaatttgttgttgttgcttggttttgtggggttttttgtttgtttgtttttgagacaaggtctcactgtcacccaggctggagtgtggtggcatgatcagggtttacttctgccttgatctcacgaattcaagcaaacctccttactaatcctcccaagtagctgggactacaggtgcgtgacaccacaccctggggtgtgaactgggatttgatgttttcagttggctccctaatggaataggttcctttactattctggaatacagattgtcattctcgtgtgcattatatttctactaccctgctaatttttttctttttttttttttctttttaagatggagtcttgctgtgttgcccaggctctattgcagtggcaggatctcagctcactgcaacatccacctcctgagttcaagtgattcttttgcttcagcctcctgagtagccacccggctaatttttgtatttttagtagagacagggtttcaccatgttggcaggccagtctctaactccttacctcaagtgatccacctgcctcggcctcccaaagtgctgggattacaggcatgagctaccacgcctggctctcaaaccattttgagtaagcaaagacagatatgtctggctttttagtacgttgctgaattagcctccaatctatatttttaggaaggacctggggaatggcaacatggagatatttggctaaaatgtgaacctttcatgttctgcttcagtctctttttgaaaatccttccaatttgccttttgcaaccagttagtggccttgccttcttcaccatcatgtgaattaattgataaagttcagaatatttgggctcaaagatttcaacagttaagtcaaattttctgccacaccctgtgggatcttggagcctgctttagaaacagaagagcgaaatgtatttaaatttagatcagggaagtcctttataatcttaattcacgttttggtgaagcggtatacacaatggtaggctcccctcttcctgtgggtttgggttttaccttgaaaggggctgtcagaacagaagtttcagggaaggggccagagctctggggactttcctcaggtgatggtaatggaagaagaggcaaggcaggacaggaaggctcaggtaagaaagactatgcaggtgcaggggcaggaggaaaaggagcagttggaggcgaaagagacaaagcctcctcaatatttctcaattcagaaaatgtcagtttacctccttcagcttatttcctcaatggaggcaattttctcagttcttttagaaatttagaaatttagaaatttctaggtctcattggaagtaagtctcccatttaatttgtctggttgtaaaaccaaatttctctcccttttttttttttttttttttttttttttgagacatggtctcactatgtcacccagactggagtgcagtagtgtgatctcagctcactgcacactgcactcactgcttgctgcatgacagccagtaagtccagggacaaggtgtaggggcagggaaggtgactttattccagagagccaccaaactgaagagatggtgaacaaatattctaaagaaccatcttaaattaatatgattttcaggctccttgtacgttagggaagggaggaagaaggaggtggttgaggtgaagaggtctgacaatgacagacttatgggctgcagtgagagccaaaggggatggtgaaaattctttgtcttttgtcaggtcacaatgctcttataaatcttcaacataacactgttacttgtgcatacaacctctttatcttttcaggagtcagtttggggaagggattatgatcatctgtgttttaaagttaaactgtaagctaaatccctcccatagatagctcgggaggggcctatctgcagaaataaggaaaagcagttggcctgaaagatatcaccacagggcaggaagggttaggagcaaaatgcagttagtcatgctaagcctccttttcattgctatgtatttaatttacttgaacacataattttaattttatatatatatatatatttttgagacagagtctcactctgtcacccaggctggagtgcagtggcatgatcttggctcactgcaacttctgcctccctggttcaagcaattctcctgactcagccttctgagtaactgggattacaggagcccacaaccacgcctggctaatttttgtatttttagtagagacagggtttcaccatgttggccaggctggtctcgaactcctgaccttgggctcccaaagtgctgggattacaggcatgagccactgcgcccagcctaactaagatcattaaaccattctaatttgtcaaaagagtcacactgatttttgaaaaataatgtaatgggctgggtgcagtggctcacgcctgtaatcccagcactttgggaagccgtagagggcagatcacaaggtcaggagtttgagaccagccggaccaacatggtgaaaccccgtgtctactaaaaatacaaaaattagccaggtgtggtagtgtgcgcctgtaatcccagctactcaggaggctgaggcaggagaatcacttgaacccgggaggcagaggttgcagtgagctgaaattgcaccactgcacttcagcctaggcaacagagtgagactccatctcaaaaataaaataaaataaaataaattaaaaaaataataacataatgaattttttcatgtctttatatattaaatatttacattatttaaattgttcaaaagcatcaaagattcctctctatcaacttcatttcatttattttattgtaccaaactatcaagaccattaatttaatctacagctaaatctattattttttcatgttagaaattccacaagaaaatttttccctaatgaaacctcacatttcaagcatcctaagtaggctgggcgaggtggctcacacctgtaatcccagtactttgggatgctgacaggtgcataacttgaggtcaggagtttgagaccagcctgggaaaaatggtgaaaccctgtctctactaaagctataaaaattagctgggcatggtggcatgcgcctgtaatcccagctactctagaggctgaggcagggaaatagcttcaacctgggaggcggagcttgcagtgagctaagatcgcactactgcactctagcctgggctacagagcaagactctgcctcaaaaataaataaataaataatcataagtagtaaaaaagtaaaatgaaataaaaaataaggcacagtgtcttgctctgttatccaggctagagtgcagcagggcaatcatagcagaccaacttggaacttctgggctcaggcaatcctcctggttcagcttgccttgcatttttttagagatggggtcttgccctgttgcccaggctggtctccaactgctggcctaaagcaatccttctgcctcagcctgttgagttgctgggagtacaggtgcaagacatgcagcctagcattgtagtaaaacaattttcaacaaattcttaattttctttctttttcttttctttttttttttttttttttttttttttttgagttgggcgtcttactctttcacccaggctgcagggcagtggtgcaataatagttcactgcagcctgcctcagtctccctagtagctgagattacagtcatgcattatcatgcccagccaactttaaaaaaattagctaatacttaaaaatttgtagagacaggggtttcactatgttgcccaggctggtcttcaactcctaacctcaattgattctccctcctcagcctcctaaagtgctgggattgcagccatgagccaccatacctggtttaattttcttattttaatcttatgtaagtgattattattgttcctaagataattggggcagtgactcctttaaaattttagagacctaatttatctattcacttcactgaaagagtatgccaatttgtttcatgagaaaataccctacattcataaagcaggaaaattccttccaccaaactagggggcattctaaagaaacaaattttgctaagtaacatcacttaaggtgaaaacagagacaatggtatctattaacaatgtttatcagtgaaggaaataaactgaaaatattaacatcattagatccttggagggccttcattgctgaaaaatctgagtaatattgtgatacccttttgagtccggcaggacattctctttccagggcatataacaatgggtgaataatttcttttcattcattttcattaagggctgaacttccttaatgttctggagattattaaatttgatttgtatagttgtgaaaagtgctcatattgctgattccattgcttatatgtgatcatataaatcttttctctcctttctgtagtgtggtttaaacttaatccttaaaggacgtgtatttgaatttttcagctggttagaaacctgaatataccaatcaaagaaaactgctccttacatgctacagatttagttttcttcttgtactaagatgtcttttagatatagtaaatttgttaaagccaagagctcctatggaatgaagttgaatgggaggggggatgtggagtagtaagatcacccttgtaacagagatgccactcttgcagattttgacaactattgggcccataaaacttttaccaaatattggaaagacaagatatgaacagcttattattgctgcagtctcaaatatcaagaaataccattattctcaggacaataaataggcaataaaaaagactcacagaccagattagctgtccaaacagggagtggatccttatcaacacaacccaacagagattgtccccagaaattcacttcataacatcaaaaccaaaaactcacactgatggcaaaaaataatgatgcaataatgagagagagacagagagagagagagagagagacctgtcctatagccatacttagtgggtaaaagccaaagagctcaatttctgctcatgatacttaatagaacagagggaacatgagccaatagctcagtgggttcagatacgcaccaagtgcctgttggatacaggattctactgtctccaataatatgtctcagatggactagtttttttgttttttgtctgttttgtttttgttttttattttttgtttttgagagagagtctccctctgtcgcccaggctggggtgcaacggcacgatctcggctcacggcaacctccgcctcccgggttcaagcgattctcctgcctcagcctcccaagtagttgggactacagacgcacaccaccacgtctggctattttttttgttttgttttgttttgttttgtatttttaacagagacagagtttcgccatgttcgtcaggctggtctcgaactcctgacctcagttgatcagaagtaggtgaggtcagaaaacataccctgggagaggctggcacaatgcccagatccgccatcgctaggcctggggttttcttctgtagtattcatgtagtgcagggacaaaaccaattagatacttctgggagttaaaaagagattaatttgccgggcgcggtgtctcacgcctgtaaccccagcactttgggagggttcacgaggtcaggagatcgagaccatcctggctaacgcggtgaaaccccgtctctactaaaaatacaaaaaattagccgggcgtggtggccggcgcctgtagtcccagctactggtaggaggctgaggcaggagaatggcgtgaacccgggagactgagcttgcagagagtcgagatcgtgccactgcactccagcctgagcgacagagcgagactccgtcaaaaaaaaaaaaaaaaaaaaaaaagatgaatttacagtgtcatttgagaaggggtattaaggaatttgccagggtactgacgcgtgtcagttgcaaactgcaggttgagagagagctaagtattttctgtccatgaaggtgataagcgagggcctgaagaaagaggaaggggggaggacactggcgccagaaataggaaagggctgcttgggggtgggaaggatgggtcggggtgctatctagaaagctgcctggcaatggctgtgggatgcggaagcgagacatcaaacaagaagctgtcgcttaaataaagtctgaagaaagactagatatgtaaacggcaggagatagtagggaaactggacccgtctcctcataaaacttcccgccttatatttcagggaggatcgcagcgcatttcggccaagacaggtgagactgcggttttgacctgcgggcctcgatgaattgcgttaggacacctgggctccgggagagccgttccactccgcaaagtaagcgtgttatgtctacaacccaacggggacgcgctaagagccctaaaggccctgctttcatcccaaagaacagcccccgcctgcgtagtttgtagccggctctatgaggtgagaacacattccccgctagcacagaaatcctacagactcctgagggggctgcagctagaagcagaggctgtgtgaaatgtgactgggggctagggaaaaacacgtagattttcacagaccctgagaacccaagagactgcagaccatgggcagacaaatctctgcaaaaagcagccccgcctagataaaggaagagctgtgcggccttcgcgctagctagcttgtgtaaaggtcgacgattcttatttctcccggggcggggagaaagcgacatattactactatttctcagccttcgactgtgagagtaacgattaagactaaaacacaagccagtaaaaaaaacaagtaacccttgctgtgtagactattctttaaactacaaaaaatcaggggaaagcgcgaacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgagctcttgcacctccgccccgccacagcctcacacgcttcaccctttacacacacggtcacttgccccgcgcagccccccccccccccccccccccagccctcctagccctgacacacagctgggactctcaggtccgaccagcggtcctgaacccgctcccacggcacgggaaatccttcgtggcgcagcagcaggtggggaagcagcagcccctgcgctgcctcatctacatagaagtcgccctatccgtgatgtcaccgacagtgcctttcccagtccccgtctgcctttctgccgctcagcctaccaacccgctgccggagccggcagggggaagtgatgtctgtctctcccttttttccctcccgccccggcatctgttctcgcccgaagaagctggtccttagcctgcgctgcggagcaacctttcagtggccacctggagcctgggcaccgttcttcaaataatggcttttaattctcagacgagaacgtttaggattacaaaagaaaccggttctcttcacatccttatccttgtcatgtagcattccgcttgaaattggaagccgttcaatgtcagagagaaaccatatttatgaaatgaaagaggcttctcagatgactgcaaaccagccttccttactggttttatcactggtaatgttataaagacagttgtccagtttcatgaatcttgtaggtttttgtttgtttatttgtttgcttttgatgttgttgttgttgctgttgttttccaaattcagtattgtagaaaaatatgctgccccagaagagatgattggacactctccagcgtggtgttggactttgtcatctcttgcacagccatctccagaccttagtgtttacctcacgttagttttttatattctgcaaagacaaaaccaaaataatccaaatttgacacaaatacctgggatacatcttatttgagatgtttaacaaatgtctggatcatcttttcttacattggattataacgcaggaaacactgtgaagtaagtaaagttggaattcccaagtcaaagaccatttgaatatttacaagtagatttgaggcaggaataatacagggtggccgcagggtaacaaattctaggcagcagatttacatgacttgaggctatgggctgataagacgctgaaaaaccagggtgtggaccaagctggctaagactgactggacccaatgtggtgctggatttgatgtaggttttaccgaggccctcattatatgctcattaacatactaaatcacacacccaccagtgccatgacagttctgagaccaatatgtgatgtaaaaatggatggcaccacagttccgagaaatctccacctttacccaggaattttcatgactattccactccttggttagagaaaccaatcaagatgaaaccccagaacccattgttctctctcgggtatgcccgaactcccctttcttgagtgtgtactttttgctttgcaataagtctcttctttcactgtttgctgactcatccttgactttgttcttgagatggtgtcaagagcctggacaccacagctggggtcgagatcccgctagtgtccggggactttccccaggccaccagtatcagattctattccattgctcaaatcacaaaacatcgagtggagagttctccttggagaccataaagtaaagattctgtggcatggtggccagttaggccactggaaggcatggcaaaatattgaaaatgagagattaggtgacagtgtagtaataactgctgaatactaaatatttgagccaggccccattccctggatactgacagggagacacattgtccaggtagtagtggagaaatactttctgggtatctgaccagcctttgtggaaagaactggcaccatcctgcagatgtaaccgcctgatgggttcttcctgcccactgtacatacaaaatcaattcatggagaccatggcattgaggtaaagagtttaattgacacaggccagccacgacatgtgggggacagagttattactcaaatagatctcactgaagacttggaggtaaagggttttcaaagacagtttggtggggagggggctagggtttgggcggtgctgattgttggggatgaaatcacaggggtgtggaaaatggccctcctgcattgagtcagcttctgggtgggagctaagggactggttgatttttgggccaaatggtgccatccagtagtcagaaatgcaaaagcctgaaaagacatctcaagaggccaatcttaggttctacaatagtgatgttcttcacagcagtaattggggaagctgcaaatattgtgacctctggaataatggctggtaattatttaacgaggcatacatcttagtagaattcaggcccctttcatcctcctaacttggtggcctttcattagttttatggggtaatttagttttggggaaggttatcattttaaccaacatttttggctgtccccaacctttttggcacctgggactggtttcacggaagacaatttttccatggaagggggtggtggatggtttctggatgaaactgttccacctcaggtcatcaggcattagttacagtctcataaggagtgcgcaatctggatccctcacatgtgcagttcccaatagggtccgagctcctatgagaatctaatgccgatgctgatctgacaagaggcggagctcaggtggtaatgctccaaagcctgcagctcacctcctgctgttcagctgggttcctaacaggccatggaccagtacctgtcttgtggccctgggggttggggacccctgatttaaactataaactcaatttttcccaaagatagcttgggagaaattgcacaggaacgagcaaagacagctagcctgtgaggctagaaccaagatggagtcagccatgtcagatttctctgattgtcataattttgcaaaggtagtttctgagggactaccctgacacttgttaaaagcatgaggtggattttattgtatgtactacagtaggcaagagagaccagcagagaaccgagctcaacctcaaatacagcaggaagagttgaagattatagccaattggcaagataagaaagtcagtggatggaaaattactaagaggaacttgattagctatcaaaggtggttgggaggactcttgctaaactagactcaacagtattcttttctaaaactggacttagcaggccaagaactaatagagaaaagggctcagaggaaactactaaggtttggtcaaagatggagtccttgtcaactctaaattgaagcttctgcaaataaacgaagaccaaccaaatgaaaaaaagcaaaagctatttattctgagcttgctatggcagggagtcagccactgttacttgtgttttggcagagacttgaaggcagtcagaagggtgagaaagctttttaaaaagaaaggcttcaggtatgcttggactggaggctgtcagtatggtgacgctgtagatagatgaagaaaataaaaatattttaccccagaatatatttctttggtatattttaagatggctgtcagagagccagcaaacagaagtaactctgcaaaactgtcttttgtaggggaaatttacacctgcagagaatctgcattaatccagccttcccttgtcaggattgagaaataaaaataagccctaggccctacaaccaactgaacagactccctcttggctgacaggaccacagagaaaccttgaaagctgtttctggctgtgacaggataggaggtcggacgtgcccccttaaaacccctccctcactaactgccattatgaggcaggagaatagcagagggaattggaagttggataaaaggcagaatgagtaaaggcagaaacagaagcaaggtgatggggcgggagagcaagaagcaaaataaaaggcagaagttgagcaacctaaacaaaaagtaagattaaaaaaagcaaggaagaccgggcacggtggctcacgcctgtaatcccagcattttgggaggccaaggcgggcagatcgcctgaggtcaggagtttgagatcagcctggccaacatggcgaaaccccatctctactaaaaatacaaaacattagctgggcatggtggtgcactcctgtactccaggctacttaggaggctgagacaggagcattgcttgaacccaggaggcagaggttgcagtgagctgagattgcaccactacactccagactgggcaacagagagagactctgtctcaaaaaaaaaaaatagcaagcaaggaccccattgctggcaagatccaaaccagtaaaggggcagctcctcagagacagacatgtgcattcaagaaaaaaagcatccttaacatgactccatatgataatcagctcattaaaactcatgcatatggactacatatcttgcatgtacttaaaattatggggtggagacaatgtgcaagcacacgagggccaaagtaactaagcaacccacccatcaatctaaaggcaaacactggctaaagattaggcatccttgggaagagaagaaaaaaaaacacacataaaaagacccaaagtacaccaaactaatactgatctcatctgccacaggtcagcccactctccccactccaagaatgttactgtgcttaataaacttttgctttgctttgctgctttgtgtgtgtcatgtacattcttcgtttgggacaccaagagcctggaactgcatggcaccatctggtaagaattaggatttttttttcctaagggttaacaaaccaactctttggaaagatttgcttcactactattatcaatcaacagcctgatactttccctcccttttgtggttttgacaaagcaagcaagcagcattccctcctgataagagaccaccgacctaggaatgattctggccagactacagaggatgtacagtgagagttttcatgtcttctgcttcagcttttgatgtcagagggccacaaactccactctcagatgattgctaatgccaccattttatgaacatgggccccatggagaggcacaaagctcaactgcacttctgcacatttttcctcttataaatattcatattggaatattatttggtactgcttccatgaaagacacatttgcagaatgtactcaaattagaagcattatataaacactataatgtagcagtggtgcatccagttctctcttttttttttttttttttttttgagacagagttttgctcttgttggcatgatttcagttcaccgcaacctctgcctccgggttcaactgattctcctgcctcagcctcccgagtagctgggattacaggcatgtgccaccacacccggctaattttgtatttttagtaaggatggggcttctccatgttggtcaggctggccttgaactcctgacctcaggtgatccgcccacctcggcctcccaaagtgctggaattataggcatgagccaccatgcccagcccccagttgtctatactatacaaatatctgcagtgtagacatttccacaatgaccaaagatatgtgtacaagaatggtgactgcagcattctttgtaatcctaaaaccaaaacaacttcatcccaaaaacattttttcttttttttttttttttgagatggagtcacactctgttgctcaggctggagtgtagtgatctcagctcactgcagcctccaccttccaagttcaaatgattctcctgcctcagcctcccaagtagctgggattacaggtgcatgccaccacgcctggctaaaacattttgaaaagggttaaataaatcatgcacaaactgaggaaaaatactgttttcaaaaatggtggagaggatcactatgatgatgaatgattccactggtcacattattaatagaacaatcagtaaatccaggcacatcctggagatagtactgaactcctattactaaaatatgaaaaaatggaggcacgtacattactcgtttaagcgcataagggactgaattagaatttatcacaccaaaagtgggttcctaggtatctgtttcaggatcctgagttacacaggtgtaaacccgccatttcaggagatacccggttaagaatcggatgggggaggggggctggcccttgacatggatcagtcataaattaggggtttggggctggcccttaacatggatcagtcataaattagtggcttggtactccgggaagataaaatcttccccatttgtctagtgattgacaatgcgtgaatgctttaaaagttgcaatcagcgtccctggatgggctcgaaccaccaacctttcggttaacagccgaacgcgctaacccattgcgccacagagacaagcactaccagttctaataggcaatataggaagggcacactcactaaacttcctccgtcccttctattctcagcgcccgcctggcaggacgactgagcaaggctttggaaaaccagagagattagagcggtgagttgcgctggtcacattggatacctgcgcgttaggagattctggagccagacggagagccgaatggccttcgcccgccctgcccctctcttgcttcagaagcccccagaaactccgcggtcggcgacccagcccgagccgcctgaggtcccaaggggaagctgaacgcctggtgggctcccgggatggttcttcccgttctttgtgccgccttcacccagtgaaggagcctgtatccaccctgctcagtcgcttttgggctgctgcggagcttccgctgccatcttcggatcctgtgttccccaccggggctccaccagggcagggatggtggtgagggtcgctcctgggtcccctcgcggggagcagggtctggcactcactaaggcgcacgactaggacttgtcgaatgaatccatcgtctcctttagcttttaatcctttaaagagcactgagagtggaaatcaagagattttttccatggggaagttctttttacaaagcattgatttctcggcaccccgcggggcgtgcaactggcagggcctctggtgggctttctgccgggtggagctgcgggggctcagctgggcgggggtcggttcctggggccgtagggtgggagcgggggaagggaaaagcaaaagctgggaaagaagccagggagacatgaaccagacatccagacctcctgaaaggctcgtgcagacgcacaggcgggatcttctggaagtgagaattgtttttgtttatctattgtagcagaatggggaaatggagagagaacctgaaagagccccaaactcgaggacctattgctccccaagaataacatcttccagaactagacagaaactaagcgtctggaaaccctgaaatccttggaggagtagcatcatcctgaccctctgtgctccttttggcaaaggacttgcttccattgtttgtttgttcaattgtctgtttgttaaataaataaaactcttttcatatatctttaaaagtacgttggttctattattttatgattacaaacaatgctgcagtcatcattcttctacacttgtcattggccactggtatatttccatagggtggaggcctggagagcagttgttccagcatagtgcttacatagattttatttcattccgttttctttcctttgttgctttattagctataacccttttcttatttcagtggctgctttagggtttctgggatatgtctttaatttatcacagtctgctttcaggtgtcattatgtctccctttctggcctttatcctagtgttatgtaattttactttatacattataatccttgtgattcattattattacttttatttattacaccaaatattttttaaaagatttaaattctaagaaaatgtgtagtacatgctttctaaatgccatttccagtattcgtttctttgtataggcccacatttttatctggtatccttttgcctctgcctggaggacttttaataagatttcttgtaacgtgggttggtgaattgttttagcttttgtatgtttttcgatgtccttatttcactcacagttttgaaattttatttttgcatagaattccaggttaactttttttctctgggtactttaaaaatgttaccatttatgaagcattgccattataatatcatctttctttcctgtgtttgtaagaatggcataaagccggtttcttgcggtggttatataattttcagaatgtgtacttaaatttaaaatattaaattttactaaaatactaaaaatattaatcatgaacatcctagattcatcttaaattccaccaacagtgcacttaaaatgtgcccaacctgagggtcaaacctacctgctgacgtgtaatttgtgtttgtgagacattctcaacagcatttgctttccctagctgagtgattttcctcacatctgaatgtcttcagtacaaaaggaaacctttgtctttgcaaaaatactttcaaatattcttacttcaagtaagtgcattaaaaacaaacttctcagttgcatccctggaatccgtggaaagcccgggagagacagtcaagtggttcaggatcaagagctaaacaagggaagacaaagcgtggcttcttcactaggagtccagccaaagtcaactgatttggtctccagtggaggtcggaactcggttcaccagcgacgtgaggacccggcccagaggaggcggactttctcttcctggtgccttcagataggaaatctagaatttctttctttccctttgatctacttctaactctcccgttctatttcttcaagacctttttcggatccctactgcgaaggacctaaggggccgatgcccttccctaacggtccctccctggctgagtgtcttcggagcccaagctcacctgtaaggttactgccctccggagacagcgagaggaccaaggagggcggcgggtgcggtgggaaccacagagtcaccgcgcacctgcgcctcgcgggctcctagcaaattgaataaatgatccctgaagcttctctgcaggtcacagggaaggggagggtaggggtcgacccgcggaagaagcttcaagaagcatcgggaggacctggccctgcctctgggccttgaaaacaggcctggccaggctgattttgtcgcgtaggcccaaagaaaagtgtcaagggcggcccaaaccctgacctcgagattaaggctcttaaatgtctgacggttttgagactcgtctgtagaatcgatcccgcctgtatccggagaccggagactcctttgccaaaattcagagaccaagaaagagaaagattgggcagatcaaagtctgtaattaacccaaacaggaaacgtaatttttctgacaaattgtatgtgtgctctgagaaaaagactagcctcaaggagaatctgtttttttggcttgagtgtagggaagaatggaattgccaccaacaatgttgcgttgaaacggcaggtgcatcaggctgtagatgtgaaggaattaaaaatatttcaccccaaaatacatttctttgacacattttgagatgtctgttcagaaagccagctgcagaagtagccctgcaaagttgtattttgttggggagatttgcatctgtagggaatctgcattgatgcagccaagtctttctttgcccagatctaggaaagattaactgagagtctgacagctgtaaaggtctcaaagaaacttttagggtttactgtctctgagagctgctacctgtaaggtttcatttacatattaagaccacctttgctagctaagcctcctcttctctccctcctataacctgtcttgcccacaataaatggatatacatctgactctgatggtacctggttttggccatgctttgagccctcattcattctgttacctcgagatggtgtataagcttctgcatcccattgtgggtagggtagggtaatcactctgtggccctccccatgtacatgttagtacattttatgccttttctccaattaatctgccttttgtgagttgatttttgagtgaaacttcagagggttaagagggagggtttccattggcccctacagttttggagctgtaagcaggatagtaaagctctgctcttctggaagctgcagtgaagaacccaggatctgatcagctgtcataagggtaagaattttttaccagccaggctcccagcctccttctctgtgtggaatctgatcaagtgcacagtaaaaatcactgcttcttttccctctccaaaatcttgattaatgggagaaaaggatttgtgtgactagtcttgggtgtagtgactctggtgtgcttttttggtactttgtggtaccaattcatattgtttaatccctttcttcccagaaaatgtctgttcctttgtctttgtctctacgtgttattctgtcataaaagggggtactggttgaggttccttcttatcttattttatgtccttgagagcttgacttgtgacaaagtgggagcactttctcttggtttccgctatcgggtaagaggtggtaattttcaggtcatattaggtggcctgtctgaaaatggctggaaacccgagtacactttttgttctaactatgtcaagctcttggggtttgtcttaagaagtcccatcccttcgaggcttttgccgtctcaactcttgttgcctgattagtcctagaaaagctcagtcccaagagggcctacctggtatcacagattcacaggtctgtgactggaagcctccacaaatttgtgggttactggaggcaatcatcatccttaactatctgtggcctactccttacattgaacttttttcttggaggggagtctttgggattgcctcttctatgcccttcccaggaagttaacctggaaaatgacatcctgggctttccacaaagaggctatttggttgaattgctattggaataattataccattggatattctagttgccaatggcctgaagatggatcccttaaattagacacctgaattaaaaaaaaaaaattagagatctcttatttgaaacagttgataggaagatcaaattaaaagaaagacacatactagtgtgatagctacccttaaaaattctcttgacaatattatctgtcttgtatagggaaaaaattctcttgactaaattaaagagcaaaatttgatccaaaacaaagttaaaattcttcataagctcaaactgcctgctctggatcccttccaggattcacaataaagtctgctctaccttgcagtttagtacttaaagttctgtgcttttgctgccatagcctgggttcaatttccagtcagggaaccagtttattttggcttgatatttgtgtgacttttgactttttggaatacccatttattgatccttttcccgttcatgggcagctttttttgttctttttgtttgtttgtttattaagacagattctcactctattacccaggctggagtgcagtggtgcaatctcggctcactgcaaactccgcctcccaggttcaagtgattctcccacctcagtctctcaagtagctgggattacagccacccaccaccatgcctggctaagttttgtattgtattattagtagagacagggttttgccatgttggccaggctggtcttgagctcctgacctcaagtgatctgcccgccttggcctcccaaagtcttgggattatagatgtgagccaccactcctggccattggcagcttttgatttcctgtcctcccaacttccaaagtttatgaagagaaatctgttgataatcttattaaagatttcttacgtgtgatcagttgcttttctcttaccgatttaaagattctctgtttttgacttttgaaagtttgattataatgtgttttggtgtcggtctctttaagtttatcttacttggagtttgcctggctactgtgtttgtattcaggtctttcatcaaatttgggaagttttcagccattatttcttcaaatattctctcttgcccctctctccttcttctttataaattccacaatgcaaggctgggtatagtggctcatgcctggaatctcagcattttgggaggtcgaggtgggaggatcacctgaggtcaggagtttgagaccagcctgaccaacatggagaaaccccgtctctgctaaaaatacaaaattacccaggcatggtggtgcatgcctgcaatcccagctactctggaggctgaggtgggagaatcgcttgaacccaagaagcagagtttgcggtgagccgagatcacgccattgcattccagtctgggcagcaagagcgaaactccatccccccaccccccacccccaaaacaacaacaacaaaaaaggaattccacaatgaatatgttggtccacttgatggtcacttaggctctgttcacttttcttcaatttttttttatttctgttcctcaaactggatgatttccattgtcttatcttcaggttcactgattgtttcttctgcctgctcagctttcttcaaatttgactttgaatccctctagttaattttttatttcacctattttacttttcagatccagcacttttttgtttcttttttgattttctatcctttatttatattttcattttgttcatgcattattttcttgtcttgtgctacatcttcctttagtttttgggtacctttaagacacctgtttcaaagtctgtcaagtagcacatccagcaggttgtttttttctctctctctttaattatttattatttttcttttcattttcttcccccatgaccaaatcttaacttgactatcaggcatttttcagtgagagtttctgttggttcatttttttttatttatttttattgttgttgttgaaaactggacatttgaatctactagtgtggttaattccagaaattagattctcctccttcctcagggtttgctgtttttctgttattgttttgttttttgattattgtaggttgtctctatgccaaggatcagcctgaggtataaacttatggtcttcacagatgttttctgagcctgaacctttccctgggtgtgtggtcactccctaattttacctatatatgcagttattcttgaatattttatcctttaatgtctggctcccaaaaggggaaaaagagaaaaattgagggagggtgaaaaaagggcaccatccctttaaactttctggaagttgcttcagcttagggtgaggagcttgctacaatgggggaaggtacagcagtagctgccagcctctttgtctctgtgctgcaatcagacattagagaacagagccccaatgtgtgtgtgtgtgtgtgtgtgtgtgtgtgtgtgtgtgtgtgtgtgtgtgttttgagatggagtctttctctgtcacccaggctagagtgcagtggcatgatctcagctcactgcagcctccgcctcctgggtcaagtgattcttgtgccccagcctcctgagtggctgggattataggtgcctgccaccacacctgactaattttagtagagacagagttttaccatgtgggcctggctggtcttgaactcctgacctcaagtaatccacccacctcggtctcccaaagtgctaggattacaggcatgagctactgcacctggcccagacccccagtgtttggagacagcattctttttgcccattctggatcctgaaagatgtgtgcagcttactgtaggaacacaagctgactgccttgggggtagtgttgggtagctgctattgtgctaagggccgaaattgactgaaattacctacaatttaccatctgggccttcctctggaagttgcaagccttcagtaggctccagagttctgaaatatttacatctgacagatcctgcccatgcagttgttgtgtagattccaggtgcttctcattccaccatcttcccaggataccctctgaccttctggattttgaattcagtcaagctgttctctaacagctggggtgaaagccaacaaagatcctgctaagaaagctccctggaaaaaaaatgttcaaaagtaacacaaatatcaaactggaaagaaattgatttaggaaccgaacccaggttgtcatggtgaaaaaaggagcagaaccttagctaccgaactgcagcctggggtatgaggtgacaaccatcacttttttagtttggtttggctagcaaaggtggccttgttatacaaataaagccactcaggtagtcaaaacctttattttctgttttttttctctctctttttttttctttttgagaaggagtcttgctctgtcacccaggctggaatgcactggcgcaatcacggctcactgcaagctctgcctcccaggttcatgccattctcctgcctcagcctcccaagtagctgggactacaggcacccgccaccacgcctggctaattttttgtattttcagtagagacgacgtttcaccgtgttagccaggatggtctcgatctcctgacctcatgatccacctgcctcggcctcccaaagtgttgggattacaggcatgagccaccgtgcctggccctatgcctggctaatttttaaaaattttttgtagaagcagggtttcgccgtgctccccaggttggtctcaaactcctgagctcaagtgctccaaccaccttggtctcccaaagtggtgggattacaggtgtcaaccactgcacctagcctctaaatccatataaatcaattattcacgcactgagcagaatattcaggattttttttcttataatataaatgatgtggaaaactggagaaccaaagaagaacaccaagactatctaaaagtgttaaatttttcattagaaagaaaatgacttcatgacagttcttaagacaatgatagaacttggggaaatatgtattccttgatgtttctatgcatttgcaataataaacaatgaaaatatggttaaattttagaaagagataggcctgtggtattgtcacaagggtatacaaatactgagaatgactgctgaggcagtgctctccattggtggtgaccttcagaagagacctgtgtttccacatggcctagacacctggaaggcagagatcctaacattccatgacacccccaccttctaattctgttattgtgactccagaccattacctggcaccgggtctgatttctggcattcctatcagagcctgagtcacagacagtaccttagactctaagcttaggcaccttgtgccttgtttttgtggctaaggattctcagagttgtaggatgctgacaaagtttatcccaaaggtaatttatgaatcagatctgctttcttttgacttgtttaaacccttcatttaatgtaaagaaactttattgaggtataatttacatactataaaatttacccattataattgtacagttcaataatttttagtaatttacccaagtagtgcaaccattaccacaatccatgcatttgtttttaatttattaattgtctgggtttattctccctaggctctgattgtactttctccacaagcttcagcatggcagtatctctcaccacttgttttggtccaagggcagaaatgagcatcctggaaaccaatcagtacttgctctctgaactggaaaagtgcaaagagaacttccgagacctcacagagaaattcctgacatccaaagctactgcctactccctggccaatcacctgcagaaatatagtaggtcccataggggcatggtcaccaaagtgataaatgattgtctgtctttcctctgtgaaatgaaacactgcagactttattctttatcaaaattaattttatcctaactacactcccagaaaggtagaagtgggccttttactctcaatttgccaaggacagaaaaactgaggcacaaaggtgtaaagtttgcagggcgagtgtagtgaggaatagagactaaaaccttggtttaggcatgaaactgtctttcccctctcagcaatgaatatcagattctacaaacatgtaacatcactgttggttaaaacatctcaggatttgatttaaacttttttaagagcgcccatttgcaaagcactgtgccaacagcaccagggatgaaagaagtaatagtataccctatctgccttgaaggaacttaaaactacctattctcaactgagtcacagatatgtggagatgcaaacttcaatagcagacacggagaaaaatctttatgatacctggatcaagattctcttcccacataagttcacataagccattcctcatgttctggttagattgagggtatttccataaaaatcagtgactttgttacaccctttctgtctctctctgagtatcaactttacagacagcaagcaactgcaggtggatgtccaggataagagctatgagacatatggccaaaatgagaacaaggccaagtggaagagaccgccattctcagtagacggccaggccaggttaggggctggccctttcctctccacagttagctctcacatttttaaatccaatgtaaaatcccaaacctgttactaatagtcggagaagggggaagctataatgacaaggaaacatgggaacaagggcatgagaggaacagggatattagaagaggattctggttaacattgaaattgagtttgctttccaatttctacaattgtttttaaataaatcatcgtgtggggggtggttaaatttgctgtctaacttactgtcatagaaaagtaaagccaaaagcccacttattaaagaagtgaaaagatgagctttggtttgttgaaaaactagttaaaaaaaaaaaaaacttcattcattataattgtaggaaaaatatttctcaagctagagaagaagaaagatattacctaagaccttagtataaaggtattattgtgcagtgattaaagagcatataccctagggccaaatctcctgggttcaaatctaacttattgtctctgtgcctcagttttctcatctgtaatggtaacagagtaggaactacctctttggatagtggtaatgatcatatgatcataattcttaaaaacctactgcaacagtaccatgacaaacactatgtgttggttctccctttaaaacactattagcatttgggcatatatcatttggatctttctcctccatatacagttttacacagttgtatacagataaatgtttaaatctttgaaatattttcgaattattgaaactcttgaaacaggagaaccatcagttctacagttcttagtatcttcctaaatacacaggaagtcattatttcatgcccttatgttcatgttttacttaagaggctgtaaagcttggtgaattggccttaagatttgaagtcatggccgggtgcagtggctcacttactgtaatcccagcactttgggaagccaaggtgggcggatcatttgagatcaggagttcgagagcagcctggccaacatggtgaagccctgtctctactgaaaatacaaaaactagcagggtgtggtggggcacacttgtaatctcagctacttggaaggctgaggcaggagaataacccgggagtcagaggttgcagtgagctgagatcgtgccactgcattccagcctggggaacaaagtgagattccatctcaaaaaaaagaaaagaaaagaaaagaaaaagatgtggagtcagaccccatgggacgtgaattctgactgcttcattccagttgaatcatcttgtcaagttactttatcggcctgtgggcttttctttcctcatctctaaaacagggagtagttgagagactgaggaataaagatatggaaatcccagtgtaaagcctggtaccggggatacttttatccttgagatagaccctgcctcctgccctgcaggcagtgaccacagcagcatggccagccttccatgatgcaggcatgtctgtcttctctcagagtgtgaagagtgcaaagaccttatagaatctgtgctggaggaggagctgcagtttcaggagagggagctgaccaaattgccaaggccagcagcaaggctccggtaaggaggtacctctgtgggaagtgtataaatactgtttgaggtggggcagctcaggcaggtagaacaaagagcaaatttgtgcaaggagaagggcagaaatgtatgaggcaggtacagaactagactaagacacaatgaggctatagtctagttaggtctctagggttttccattaaagaacatattagtaaaatggagacagctgcctgcattggaatactagcaacgtggcttctatttgtgtatccttggtcaaatttactgcacttttctgcatgtcattaacctaggctacctcatttataaaacggaaatactgacagtatctaccttagagggttatgaagattaaatgcacaattgcaagtagttaaaaccatctctaacacatataaaactctgaacaactattttctgtaattattttatttgttcccatttatagatgtggtgattgtcattaacatttcctataagagatattttcaaactttccaaagtgcctttcatgataagaaagtttctcctccaaacttttttaaaaagtattatactaggtgaagtattaactggtagggctattgggtagatagatgattgagcagctgttgtgtggaaaatgaattattaattcactcaggaccagcattgactatccttagagggtttcagacataaggtagattgtagcatttgaaacttcttttaatcctttgttgaaatgaaatcatagaagctcaaatgtgtaaaactcaccaaagcagagatatttgattgaaggagggataggtctggagcccctgtttctcgccagtatgtgtctttacttcccctgacactgtctagtaactctgtcgaatagagtttgaaagaggacctgcagataacaactttgaagaatagcagggagaaaattcaagcattagatggggtagatgactgtaaatgttcagtccagctctgggattacatggttctaaacattaactgaataactacttgtatgtgtacatactaccaggtgctgtgagttgggtaataggtggcactgtctttagactcacagagctcacactctacattggaacccatgtgtattagtccattctgacactgctataaacatgtacctgagtctgggtgatttataaagaaaagaggtttaatcggctcatggttctgtgggctgtacaggcttctgcttctgggcaggcctcaggaaacacaatcattgcagaagttgaaggggaagcaggcatggtcttcacatggccagaacaggagagagagagagaacaaagagggaggtgctacactttcaaacaaccagacctcatgagacctcactcactaccacgagaacaggaagggggaagtccacccccgtgatccagtcactttccagcaggtccctcccccaacattggagattacaatccaacatgaggtttaggtggggacacagagccaaaccatatcaccatgagaaatatttgaacaataattagaaagcaatgaaatcccacatagagtaatgaagttactactcagaacattacttcttttttttgagatggagtcttaccctgttgccgaggctagagtgcagtggtgtgatctcagctcactgcaacctccacctcctaggttcaagcgatcctcctaggtcagcctcccaaggagctgaaagtacaggtgcacaccaccacaccagctaattttagtatttttagcagagatggggtttcgccatgttggccaggctgctctcaaaactcctgacctaaggtgatccgcctgccttggcctcccaaagtgctgggattacaggcatgagccactgcacatggccggaactttagttttaactgccttcttactgattatggtctaccttcatgtcattcaaaagaatactgcccttcttgaccttttcactgatttttctttttaactttcaattaataccagagatacctgcccaacacttttgaatctggctttttttttttctgccagttactgcataatgcttgatgtatattgtatgaaaatgtacttgggctaaagtggggaaccaaaggggcatctttttaaagcaaaggtagtaaaataacagacaaacccaaggctggttcttcattccttctgccacaggcaagtcacacaacttgtacaagaattaatcttgggccagatgcagtggctcatgcctgtagtcccagcactttgggacaccgaggtgcacgagtcatttgaggtcaggggttcgagactagcatggccaacatggcaaaaccccatctctacaaaaaatatataaattatcctggcatggtggtgggcacctgtaatcccagctacttggaaggctgaggcaagagaattgcttgaacctgggaggcggaggcagaggcggaggctgcagtgagccgagatcttgtcactgcactccagcctgggcgacagagtaagattctgtctcaaaaaaaaaaaaaagaaaaaaaagaattcaacttgggagttccttacagggattctaagagatctctcctctgaaacttctataacctattattcactacattccctcttacattttactcttctttcccaccttaggatacatgatcccttaattcaggctcaggctgaagaactgacccacttacgacagaagatacaagaagggagaggtgtctgctaccttttcacccagcatgtgaagaacacagtcaagtcttttgagggccttctcaggaacactggcattgcctactaccagagacagagattctgtgagcaaatggtacaaggaagccagctaacagagatccttgtcagaaaacttgccacaggtaagttggctacaggctctgaagacccttacctcctcccaagtgccccaaagtggggagaaaaaatgcaaagttatctccattgtagattttattttagttttgactatggtccttaatctgcattctattgttttctctttagagcactcaggtaatcacttttcatattctttcaagagtcctgagttttgttttttattttgagacagagtctgctctctaacccgagctagagtgcagtgacgcgatcttggctgactgcagtctgtgcctcctgggctcaagcagtcatcccacctcagcctcccaagtagctgggactacaggtgtgtgccaccacacctggctaattttcatattttttgtagagacagggtttctccatgttgcccaggctggtcttgaactactgagctcaagtgacccatctgctgtggcctcccaaagttctgggattacagatatgagccactgtgcctggcctgagagttcttagtttcaatcagtaagagaggtagagtatagtggattacttcatcttgatgagcataagaactcaccttcatttctggaagatattttcactggatgtaggattctagttgacagtttgtgtttttaaaaagtgtttgaaaagtgatattccactgtcttctggcttacattgtttccaacaagaagtcttccataattcttatttttgtttctctgtacataatatgtctttttctctggccgcttttgagattttctgtttatcactggtttgaagcagtttgattaaggtaagaccatgtatagttttatcttttaagtattgttttactttatttagtttcttgcatctgcatgtttatagttctcatcaaatttgaatagtaatgacatatatagtcttatctatggcatatacagtatatttggcatatatatatcaaatatatataatgtatattctattctttctctctatcctctccttcaaagactccagttatatttgtattagctgctttgaaattttaccatagctgactaatggtctgttcatttttgttgtatcttttttttctctctttgtttctttctatttccatgtctcggaattgattaatctttctttagcagcatctaatctgctgttaatcctatccagtgtattttcatctcaaactttatttttctttttttttttattttccactttgtcattgtgtgttggttttttttttttttttttttattatactttaagttttagggtacatgtccacaatgtgcaggttagttacatatgtatatatgtgccatgctggtgtgctgcacccactaacacgtcatctagcattaggtatatctcccaatgttatccctcccccctccccccactccacaacagtccctagagtgtgatgttccccttcctgtgtccatgtgttctcattgttcaattcccacctatgagtgagaatatgcagtgtttggttttttgttcctgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatggcagcatgatttatagtcctttgggtatatacccagtaatgggatggctgggtcaaatggtatttctagttctagatccctgaggaatcgccacactgacttccacaatggttgaaatagttcacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcctttgctgtgcagaagctcttcagtttaattagatcccatttgtcaactttggcttttgctgccattgcttttggtgatttagacatgaagtccttgcccatgcctatgtcctgaatggtaatgcctaggttttcttctagggtttttatggttttaggtctaacgtttaagtctttaatccatcttgaattgatttttgtacaaggtgtaaggaagggatccagtttcagctttctacatatggctagccagttttcccagcaccatttgttaaatagggaatccttttcccattgcttgtttttctcagatttgtcaaagatcagatagttgtagatatgcggcattatttctgagggctctgttctgctccattgatctatatctctgttttggtaccagtaccaggctgttttggttactgtagccttgtagtatagtttgaagtcaggtagtgtgatgcctccatctttgttcttttggctgaggattgacttggtgatgcgggctcttttttggttccatatgaactttaaagtagttttttccaattctgtgaagaaagtcattggtagcttgatggggatggcattgaatctgtaaattaccttgagcagtatggccattttcacgatattgattcttcctacccatgagcatggaatgttcttctatttgtttgtatcctcttttatttccttgagcagtggtttgtagttctccttgaagaggtccttcacttcccttgtaagttggattcaaactttatttttcatctaaatttaatgtatgtctttctttaaggtcttctatgtaactcttcatcatttcgtattttgatctagcttctttattttattttattctattttttgagacagagtctcactctgttgcccaggctgaagtgcagtggtgagattttggctcactgaaaccttcacctcctgggttcaagtgattcctatgcctcctgtgcctcagcctcctgagtagctggggttacaggcacatgcctccacacccagctaattttcatatttttcagagagacggggtttcaccacattggccaggctgatctcaaactcctgacctcaggtgacccacccgccttggcctcgcaaagtgctgggattacaagcatgagccaccacaccagcctagcttctttaatacaaggaatatagttatgtttgtttcaatgtgcttgtctacagattctgtcatctgtgtcctttttattgttttttaattctcacctgatgtgtcctttctaagtcagtttaagtagattgattttttcccccttcttatcatggattatagttttctgtctgtctgcattcctaacattatttgatttggggttagacgttgcaaattgtaacttactgagttctggatttttttgaatttagtgttaaaattattttagctttgttttggtatacaataaagttacttaaaaacaattttcatcttttcaggatggcttttaaatttttttaggcaggataagagcagctattagtcaactgctatctttttcccactgtggaggcaaaatgacttttaagaaaatagaccttattttttagagtagtttcagattcacagcaaatgagcaggaagtacaaaaagttcccatataccccctgcctccacacatgcatagcctcctagattatcaacatctctctccagaatggcacatttgttacagttgatgaacttacaatgacatgtcattatcacacaaagtccatagtttacattgggagcaataatcttttgaagattctaagtcagtgatctcccacagatttggcaccagggactggttgcatgaaagacaatttttccacagacaaggtgggggtggggtggtagggattgggaattgggtggtttcagtacgaaactgttccacctcagatcatcaggcactagttaagagtctcataaggagcgtgcaacctagatccctggcatgtacagttcacaatagggtttgtgttccaatgctaatctaatgtcatcgctgatctgacagaaggctgagctcaggtggtaatgctttctcgctggctgctccccttctcctgtgcagccccattcctaacaggccatggaccagtgctgggggttggggactcctgttctaaccaatgctccctctattaaaagggattttcactctagctgatggaaacaccaagtgttgcaagctatgtgtgagctacagagattattccttttgggaagttctttgccctgctttgcataatttcctcaaatacatgtactaatcagtacttagctgaagattgaagacagatatccaaggcattctatctgtgcagcaacctattctctagtctgtcctgtgatgtctagccaccctgacttcttcaaacttactaccaggctctgcctgggtcctccctccctgctctacagttgacaatctcaggcagcaaactggagcaattatagggctcacctcttttatttattatagtactgcactatatccaatgttgaaggtagagtttaaaatactttttccagtttctcagttgtttaaggtggaggacaaatcaggtctccattactccaaattggccagaagcagaagtctccattccatctttgtggtcagaaagaacagtatgacagaaggcagcttgttagaatgggaagacccatgggctaagaatcagcattacctaggctctagtctcagcactgtatttactaactttgtgcaagtgattgatccttcttgaatttctgtttccccatttgtaaagtgggtcaaatcataattccatggctgctgtacagatcagttgaagtagtatcttaatgttcatgagtgtatttctctttcagggttatttatttttttatttttgggtcccaataaaccgtccaaatcttttggggttagttcaggcactgtatatagtagaagctggtgttagaaaagttgatttatactggaatatttttcacagaatcaaccccaatgctcactaacaaactgagaagaaaaaaaaagaattacccccaacaacatctgaggaagcagaacagggacagacttgaaggcacctgggcagtcctctggttttggagtagaggtaggacagggctatttgtcctctcagagactggagcaggttctgtgtgtgagtagcaatgggacaaacagtcgtggtctggcaaccagcctgtagcaggaaggaaggttacaactggagaagtccaaagggcaaccaggcaagtattctttgagctggggaacaaaaggcattttaaactttttgctctgcttcaggcagctgacgtctggtgatgattcaccatatcaggaacaccctgtccagtgggctcaggcaagcctgccaggccacttctctaaagacacaacctgaggcctcctgcaataattctcacagagcattctgaacatacatgtaaggtgttatgtccctgatcatatagggcccatgtgtgcaatgtgtgaaatgggacctgcttaaattctgactagctctttctaattttggcttgcagaaaatcacaatggtaagaaaatgaagacaggcaaaagccactggctcccaggtaactctacatgatgaaggggctgataatggactgaccaaatctagagagaattccagaagcaaggactcaagaggttaaaggtcccagatctagaaaaagcagaaactgctgattgttcctttttttgttgactgattatacaatgtgtccttttaaaaatggttctctgttctctttgcagttgttgtattggttcctagttcctagtaatttctcacacttagttaaccagtcagtcttaccgaaaagtaaactaaccagggatccctggtttctgtatctttaaaacctatagggttacaaaccaaagtgagatgcctatctggtttctgcacagttgtcctgaattatgttggcagatattttatagccagaaatttaccttgaaaaataaattgaaaccataccaagtatttagagctaggggtctaaaatctgcaaaagccctgggaggttgtgttgtctcaagagccagtattcagtggaccactccacatcatattaaataaaatttaaacagcattttgaagccgacagtatgggtcactgtgtgtcctgtgtgccgtgagcgtattgtagagtagttgttgagtctgctgccttatctgtgtgttatgaggtcaatgcactgatcacttgcttttttcacttctatactaactctaggcacactttactcccagtcaaaagtggactgtatacttcctctttgatgtgatggtccctttggttttggtgcctcttccatgagcttcagatcagaactagctatgtggttccaggctgccctggtttaatcccttgtcttgcctacttcacctggctcaagagggaagtccaggaggaagaaatggatgaagtcctggaggactcactagatgaacagtatttgactcattccagctgccatgactcccaccagcttcccagcagcaatgccttcctctttgatgcacaggaaggcccctcggctgtggaaatagccagtaagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaactctcaagtacaggtccctggtgggtcaggtaatttgctctgttcctgtcctcacctcagtccctctggtccagacgggcatctgcaagccggtatactcaaagcaggccagaatggagagagtgaagagattatggcagactctctgccactactgccacacatgtacaaatctgtttaacagatcttcttctttaaaatgggacatctcatctttcctgaaatatatatattttttgagacagggtctcttgttctgtcacccaggctagagtgcagtggcatgatcttggctcaccacaacctaaaacccagggtcaaatgaccctcccacctcagcctcctgagtagctgagaacacagatgcatgccactactcctggctatttttttttgcctttttggtagaggtgggttcttgcttttttgcccaggctggcctcaaactcctgaactcaagcaattcacccacccctgcctcccaaagtgctgggattacagatgtgagccactgcacccagccttcctgaaatattcttggtaattatagttcctgaacagttttcccaagctgttctagccatcccaagaatgttggcaggcttgtccatatgtttggaggtgcaattataatggttcctgggtttcaagctccagtctccatctcccctcaggtgcttgctttcccataaggttccatctgactactggaatatcaggggatttccataaagacaagactttgatcttggcaaccctttggtaaatagccagggttctcaatctttgtgcagcaccaaggtatttttaagatgtctgttagtttagtctcagtgttgtaattccatctaaataaacaatgaggctatctgctggagaaaaggctgaatctaagagcaatgctgccagcatgccctcttcccagaataactccacgctagccattggagcttcattaggtatataagagccctttggtttggtagcctctctggtgtgtgtatagattaaatccttgacctatatctcctctcccttacttgaatgtttgactttactttgggggcaaaagtttggattgttaggagactatatgctttatatactcttctatgcaataaaaagagattatattaattcactcattgagctttcacagtaatgtaaaccatattaggcttgtcattctgtcagtgatgggtgtaagtttgtggctttaattagtcataccatcttctgacaaaggcatccttatttctctttccaatttcacagtaaggtgtagaagaaggtctttaccatctgttaaagatgttcagggccgggcacggtggcgcacacctataatcccagccctttgggaggcctaggtgggtggatcacttgaggtcaggagttcaagaccagcccggccaacatgctgaaaccccgtctctactaaaaatgcaaaaattagctaagcatagtggtgcacgcctgtagtctcagccacttgggaggctgaggcatgagaatcctttgaacctgggagacggaggttgcactgagccaagatggtgcctctgcactccagcttgggtgacagaatgagactctgtcaaaaaacaacaacaaaaacaaaatatgatcaggagagatattttgtagagaggaagatattccctagtacctataagtcatctcaaggaggtggtcataccttttctagtgctagaaaaggcctactcagagaccttcagtgttttcccacctcctgtcaacctgccttatacttcccatatctccatgtgggaggcatccctgtggagtttgcttagcacttggccatgctttctttgaaaccttaaaagctcgtaaagaaagttgccttatgttccctgatgagaagatgaagttggcaaaagaatggtgaaaggcagggatcttgatgagaggcccctgactatccctttagtgatcagcatcttcacttcccatctcattccatgtcctggtggaatggctgcagaagatgagatccagagccagtggcagcacctgaaagagatccttttcatcaacaactgcctgtgagaaaagctagaacatcatcacagcagctttgacgaagaaaatggtaggagaggcccaagtcagcctgcttctggcaatatgtatttttctaaaggcatgtgactggggcagagttttatagatttcaagcactttgacatactttacttcacttattcattacaaatgtcccagctagagaggtagggcagctactatcattcctatttataggtaaataaataggcttaaagatttgccttcatcttagtggtatctacctctaaaatcattcttgtgattcctaggctgtcttctgtcttctgtctgctgctgtacactgcctgctgtctctctgcttcttatgtgattggcattcagtagaacccaggtttctcagcacctcacgtagcagaatgagagtctcctctgctgccatcctcatcagtttcccttatgtcttggtgactcttcattctaccaccccaaggtggttctctccaacccccctcctcttagattgttctcacacagaggccgtcatttcataacattgtgctgggccagaagaatcataagcaggtcccttcccataccaaagcagtaactattttggaaaagcctccttcatattgcagccattggacatgataatacatgtgatgtgctggcatttgttgagaatcatgtgaaaattaagcttccaccccatcacactaacgttccagccctccacggttttctccctaggctaagatagagaggaagaacatgaaatgtgcagaaagcattctcttaagcaaacgtgtataacttgcgtaaattgtaattatttcctggaacaggatgcacctctaacctctacaggcaaatcatagattccattgtccagctgtaaaatgaaaacagagttctcagagaagaataccggagactcccccgacttgcctgaatcaaatttccagaggtaagtggtgaaaggctacaatatgaagtcactctcagatgggtcccttctcttgccacactccactgtagaaataaaagaggacggggaggccagagctgctcaaaaccttataacccacaattctcatagtcattctcaacttagagagggctgctttctagacacaccccctccaggcccccagactgccaggctccaggaataagtagctctaagaaatacagtatttcgatgcgagccacaccccactattgcaaattggagaagagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcaccactgcattctagcctgagtgacagagcatgactccatctcaaaaaaaaaagaaaaaaagaaagacagaaaagatttaagagaacaattattttaattgaatacattttgtcaagattaaatcaactttcccctagaatactgaaagaataagcaatcataatttagattctaagttactggcctttgagaaagtgtgaaatccaaaaagatgccatgagccaaaaaagagcaaaagtcctaattttcaaactgatgaaaataaagtactaaataattgaaatcatcgtagttcatcttggtccttggcaaaataaaaatttattgattgaaattataatatcctagctacctttttgtgcctagctcttaccactgaggagaaaaaccaaacacaaacaaaagtatgttcaaattggcaaaaatgtttacaaacctgcaaaatctcttcagcctatcccttaaactgcagacttggtatttactaagctctgctgtgtacaatacccaccttaatatccattcttgcacaagttctgttaggtataagccaaaatcacatgggatttttttttttaccctctcatgcctatgtttgcttttgcttccaaagacccttctgagtaaggactgtcctcagactactggagtcacttagtcacaagcttgcctgaggctcagagctggcaatacctggcagtttatgtcaatcccacatgcaaccctgcctgcaaagtatttacccatgattgacaggtgcaggtgtatgaaagcccagctccttgacttgaggggtgcgtttgtggtgaattagctttgggaaaagggaatccagaggccaactttgtaaaaatccagataggtaaatggagagaaatctttgccttggaagtccaattgagaaagatagtgatttacttcggactgtgaaaggagagactaaaatctttactttctcatgggaaagaagcctatggtgaaagagaaacaaagaaaatggtgggaaatagggtaggtctactcagtagctttaaaccattctgtcatattataaagcctggtaaggttttaactaacacaagtgcctggactctacacatagatattctgatttaaatgcttccaggtgggtggaagacaccagtagtcttaaaaagctcccaagtaattttaacatgtagctaaagatgaaaaggacaatctatctactagaatgtcaagtcgtcagcataggagtgtcccaaatgtgcagctacctcatagaaaaggcttaaccccacccattgatggaattcgccttcctctctccatggtcttgtttgcatagcatggaaaaaaagagaagagaaaaagaggtagatggatagattgaacctataatttgccaatgtggagcagtttctcaaacttttctgaccacaagatgcagtgagaaatacacaattttttgtgatcagtttttaaaaaatcttttattatgtgtaatccacccttcctggtatttaaataaagcctgtagtagtaagcagtccactatattgatttcacaacccataagttgttcagaattgcaattagaaaatttttaattttggccaggcgtggtggctcgcacctgtaatcccagcaccttgggaggatcacctgaggtcgggagtttgagaccagccggaccaacatggaggaaccctgtctctactaaaaataaaaaaaaaaatttttttaaattagctgggcgtggtggtacctgcctgtaatcacagctacttgggaggctgaggcaggagaactgcttgaaccctgggggtggacattgtggtgagccaagattgtaccattgcactccagcctgggcaacaagagcaaaactgtctcaaaaaaaaaaaaaagaaagaaagaaagaaaaagacaaagaaagaaagtaagaaagaaagaaaattttttttcacttttgctcggcctttttatcaaggaaaatcccaaaagaacatttactgtaaaagaacattgactataaacatctttctgtgaatccttatttctgtcccagccaccatgacccaataatctctaaaacctgttagtgttctccagattgaagccttccctctaactgctcctaaatctgtgatgtagtggaaaaggtttgaggccttgattctcagcccaggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttagaagggttatttctctgcaaactatcctctctttcttatgacaagctatttctgaatgtgcacatttgaggctaagcaaatcacttcctgggaggtgtgaaagacctttatttctctccagaggagtattatggaggtggtagagacctagctaactcatctgcagcggctttgagcaaggcttttagaaccataaggtggctggggtcctgtgtcctacaccacaggccagctagttcatttcaggagactttcttttcaatctattattactatcttcttctagactgtagttcactaccagagattatccacttagctgcactcagtttacacctggcctgtatcaccacttagctctcactctagcctcagttaggtatcagcaagacctcaccaaagattattgtttcgttgtatgtgtgtgtgtgtttttgtttgtttcaagtagcaactaatgttggaactatggaaagttcttctctacttttaacaaagcttagtcacaaacagttccccagttgatgagaaaaactaaaacaacagaacaattgaaagtccaaatctgaaagctccatctctgagaagcaaattttatagccactccagatttgtattccaaatggatagtttgattatagaaatcacatcccttcagtctgcaaatgtgataactgaccaagagacagtgatgcctagatccataaataatcccctttcccccaacctatatataactggagtcaacagcagctagaggaaaatggcaaggacttggaatcaagattaagttagaataacactgctgtagactgttcatcagctcttcagcatatgtccattttccttgagggataagcctttagaaacctctgacaataaagtttattttacacacattctcttgcctatgatttttttgtacaaatcacaattacaaaactttcttgctccagctaaaagcaggaaactcagtcacaaatgtgttcactacatgtataccacagaatgatagcagccagtctgaatgcatcacttgattccaaaattaaatgttagcactcagtagtgaaactacatgtatctccaactctggaagccccaggcaagatactcctgtttcctgcagggaaacagatctataagcagggcagcagtctcacacatgtacattcctgggaaacccaaggaaacaatgatagtgatgcagggcaggcgagcctcaaaactggtttgtagcccgggaaatttcttccagactgtagtttccttggctttgccaaggaaagaattcaagggcaagccgctggtgaaagaaagcaacttttattgaactggtgctgctacttgcagagcagggctaacccataggcaatgtgcccagagttggtgcctgtgggctgctagctagttgtttttagacccacttttaattacatgccaattaagaggtaggttattcagaactttctggaaaaggggcagggagtttccagaaccgtataaagtaacttccaggccattgccaaggtgtgttgccatgacatttgtaaactggccatggtcccggtggtagtgtctttatgctcataagtagtaagagcaactagaggtcactttcatcatcatctgctggtttcagcaggcttcttcactgcaccttgttttgaccagatcctgctctgttcaatggggttgtgactggaaaataagtccttctggtctcctacctcatttccccatcagagattatatactcctccttaatcttaaggggcttgtagaagggtggaggttcatcttctgtaactgcttcctgctgatgttatgggcatagaacctgcctagcactggagaagtaaaatctctggatacctgttctaaaagacccaaaggcaggatgtctttattttctgggtcagaagaggggatgggttgaaagccttgtgccagcatcgtctttacatggaattattgtaatctagaagacacaaactttacaaggaggttaaacaagcaaggaccaaagattagtaataacaagatatctgttaaaggtcctaggaagggtaaaaatcaagtgtctgctggtagagattcctttattgaattccatcagcagggcaaagcggtaagagagaaaacattataattaggagtaagagaaaaactttcatgctcatccacagcatcatgttattaatatttatctgtgcatttgcaaaacaatagctttaagtcttctgggagtttgcaagtataggtcatggcatcttcctctgacatctgtgaggactcataagaatctttgaggctgggcacagtggctcatgcctgtaatcccagcactttgggaggctgaggcaggcatttcacaaggtcaggagttcaagaccagcttggccaacatggtgaaacctcatctttactaaaaatacacacacacacacaaaaaattagccaagcctggtggcacgtgcctgtaatcccagctactcaggaggctgagacaggaggattgcttgaacccagaaggtggaggttgcagtgagccgagatcgagccattgtactccagcctgggcgacagagcaagacttcatcaaaaaaaaaaaaaaaattaactttggagtttaacagcagtgggagtgcttaataatgcctgataggggccctttctattttggttgtaattgattcttgggggatccttctttctaagtttttagtaagactaagtctcctggttgaatgggggagttaatccttttccttgtgggaagttacgtttcatttccatatgattgaagggccttttgaacctggcctaagttgataatctatgtgtctcttcatcaaacagaaggtctaaagttaaaaagggccttccgagctgctcaggcgacccagtgctcggttggcccgggccgcgcttaactgtcccaggtcagttaagcccgtgggagcccaggtcatggggcagccagggcctctgcagtgtgaggcgccgggctgcgggcgggcaggcgggaggcttagggtgggtcgcggtcgcggcccccgccgcaggccctggcggcggcatcgtgaacatagacgtggagttccacatccggcacaactacccctggaacaagttgccggccaacgtgaggcagtcattaagtggagatagctcatcatggaggtcttcatctttgtcttcacatcaagtaggctgaggaggaggaaatacaggaagtattggtcttgctgttcagagtggcagaggagaaagaaaatcccagccgtcttggaaattcacagagagaatatgaaaatcaggttgtcctgtacagtatctgcaatcagttacgatacagaaataacttaaacatgtcaagaaagatgaacgcagatactatgaggaactgctaaactacagccgagatcatctcatgctgtacccttaccgtctattggatattatggtgaagagcttgagcataacaccattttcatattacactgggattatggagaatattatgaacagtgggcacaattttactgctgctgactgtctaaggcttcttggcataggaagaaaccagtatattgatcttatgattcagtgtagatcatcaaaaaaattcttcagaaggaaaacagccggtgatcttctaccaataaagccagtggaaattgccatagaggcatggtgggtggtgcaggctggatatatcacagaagatgacatcaagatatgcacttggcctgagaaatgtgctactgataagaccgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaagaatgctgtttcaatgtattgctgattgggctttgcccataagaagggacaagtaataaatttggatcaacttcattcatcatggaagaatgttccatccataaacagattaaagagtaccttagatccatagaagatgctcttgtcatggggtggaggggaaagtaggaggcctgtacaagaagcttcatcggcaactgacactgatacaaatagtcaagaagatccagctgacacagccagtgtaagaagcctgagtctgtctgcaggacacacgaagcacatcgcattcctgtttgactccactcttactgccttcttaaagatgggaaatctttcaccagttcagagcactggtgaaagagaagcacagagatattttgatcatgcgcttactctgagaaacacaatactgtttctgcgtcataacaaagatctagttgtgcaaactgcacagccagaccaacccaattatggttttcctctggatctcttacgctgtgaaagccttcttggtctggaccctgcaactggcagcagagttctaaacaaaaattacacactgcttgtttccatggctcccctcaccaatgaaatccggcctgtcagcagctgcacccctcagcatattggaccagctatcccagaagtcagctctgtctggtttaaacagtacatttacgtttatcatatcactggacaaggaccaccatcccttttattatccaaaggtacaagacctcgaaaactgccagatatatttcagagttatgatcgattgctaataacatcttggtgtcatgatcctggagtagttcctacctcaaatgtgctcacgatgttgaatgatgctttaacacattctgcagttttaattcagaggcatggtctgcatgggataggagaaactgtccatgtcccatttccatttgatgaaacagaactacaaggagagttcactcgtgtcaatatgggtgttcataaagcattgcagatactaaggaacagagtggacttacaacatctctgtggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccactgttcagttccgaattaaaccggaaagtttataggaaaattgctacacatggcctttgcagaaaagagagccttcaaaacctcttacattccagtagaaaactctctctgcaagtccttaactttgttcactcattccaggaaggtgcttcaacattggatattcacacagagcccagtttttcaagtttgctttcacagtcatcgtatgctgacatgggtgttccacttcctgcaaaaaatttaatatttaaagatggtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgtggagcaattcttgctttactaatattaaaagtttggggaacatattcatgttttctgaagttttgctccttattgcacatcttattgcaacaaagtgctttttagcatccagcactgtattttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcaattggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcatcctgatttatttttttgtttcttacctttgatgttttcaaaccaaggattgtgattttaggttagaattacatattagaaacattaagactatgtctttggatcaaaatgctttagtgattaacctactttgaagacatactcttaagcaatctgtatcttaaatttatgtgaatacatttttagaaaatgataaagaaaaatggaattacttcaaagtgtttcttgagtcattgattcttttagcatctcaaatgttaattagaataattggaatcactttttaaacttttcaagttaccttccttgggaagtttgtgtagtgttacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtatgtatgtaacttttacagtttttcagctgaaagttgtatttttttttaatcagggctctttaatctcattttaatttcctttgtttgaatgaactgtagttattttctgtattcctatattaaccatctaaaccaactgtaatgacacgtacactaatgaagaattgaacatttgtatttgttggcagtgagcccagttgttggtgaatttaaagcttaaaatatgggagtgatttgctgctatatttcttttgagagataaaggaggaagaaatggaacctaatggtaatcatgaattttagggaaagtactgaaaaaccatgcggtcccctctggtttcttgtgttgaatgaggcaagagtaatcatctgattcttagctgaagacttctcatactctcaaggagggagagtgcatttttagagcttttagcaaaaatgtgaaaagttcatgtttgcactttgctttgtgaatttggcttcattttacttatacattaactcatgtaatgtcttcaatcttacaagtattgatccatttcaacaaaaaggtaaatttaaaatgcagactttgttacttgtcaaagaagattcatgaaaaatttatatccaattattttccaaatagttaatttaatttggctttttaccacattccttcctttctttcccgacttctttaatgtaatttaaaccctggaaaacattctttagaaaccaagaggaaaagaagaacacatatcaaaaaagacatataacttaaaatggtacatttcacatctaaaatgggtttgaagaaacgcaactttatatcattaaaaaataagatcatctgatttcctttatttcttttttaaattatgtaatcagatgattttatattttttggggggggcggaatattggtttcttttacttgatgttttcagttttctctggcattcaagtttcttttttgtgttcagtgtttcaaatacaatttgtatttaaggattttaaaataccaaactgtaaatgagtacagtggatctttttctgttaggatgttaatattatacaatgaaatctataaagtgttgtcaatttgatcattgacacatatgacacgtttacaattaaactgtggtgttgatcaagttaaaaaaaaggcggaggccttccataagtcatttcaaatggactaagctttaaagttctctttggagccatcctcacatgcaaaagggttatgagtaggaggaaaactcaggcctctgaggtctcctgaaagagttttgctaatgtcacaactggctttctatgttatctgaagattgagatctccatgaagagtgaagataggtagtgcttaaggctgaggcattacctcactgggtcaccttagctgggaagggaggtcagttatccccttgcaaacattttggtaatccaaatcttgggatgatttctttaagtaagaatttagacacttccaatacttttcttgtccttgtggggaaagcttctatccacctggtgaaagtgtttataaatactagcaaatattgtagtcccctgtaaggtggcatctgggttaaatctgtctgccagtcttcactatggtatgttccgtggtgttgtacaagtttaagcagggagcggggtatggggtggcttcctgattggtaaatctttttatagtttagaacagtcccttccccaagaatatttaggaaactaatttgaatggaaaatcctgtcccaaatgtgaggaatcatgaaaatgttaaattatttcccatttgtcagcctcaggaatagagtttgttcttttctagcaagcgtctagaggggtcttactggaagccttttactcagtccctttaatttccttgggtgtatagtacggttccactgacatggatgacctggtagtagcgcagcagcctgaaataccagggtttccttagctgtggccttagctgctctttccaaaagggaatttcctctaataagaacagtgtctcccttctggtgtcccctgcagtgaatacttgttatttctttgggaattggatggcatctaaaagttccaagatctgagtaaagttgtatgggggatcccttggctcttgatagtcccctttccttccctatggttgcatgagcctgaagcacccggaaaccatacttagagtcagtaaacacattgactcttgagggttttttttttcttttttgaaacggagtcttgctctgtcgcccaggctggagtgcagtggcatgatcttggctcactgcaaactctgcctctcagtttcaagtgattctcgtgccccaccctcccgtgtagctgggattacaggtgcccaccaccatacccggataatttttgtatttttagtagagacagggtttcgccatgttggccaggctggtctcgaactcccaacatcagatgatccacccacctcggcctgccaaagtgctgggattacaggcgtgagccatccaacccaggcttaagtcttttcacagttggaaggtcctgattagagcagctaattctgctttttgagcagaattctgagaaggtaaacccttggcctcaatgacttcttgttagctaaccttcctttcttactccctcatgaataaagctatttccatctctaaaccactcaacactggggttagacaagggcttgtcttcaaggttggaccttctagagtagatctcttccatggtttccacccaggagtcaatgagttggggatctgtttcttgggatgtgaggtccagcaacagagtagcagggtttaaaaatcagcatactttaagggtaacatctggggtgtcaagcagaagagcctgatatttaagtaactggccccctattagccatgggtatacttttgcctctaggaccctctgtactgtacttcatggggtggtggggggcgggggtggtatggcatctacttgttgtcccaaggtaaacttactggcttcttccaccaatagagtgatggtagctacagatctcaagcttcctggtcactcagctgccacctggtctagctgtttagagaaataagccactggtctgaggcaattcctgacccttcgagttagaacatccaaagctgtcccttgttattcatccacatagaggatgaaaggtttttctaagttcgagagtcttgaagcaggggctgtccctggcttttcttttaaggctaagaatgccttttgacagtctccattgcaattcaaaggcttatgaccactcacttttggaggttcatagagtggttttgctatgagcccaaacctgggaatccaaacccagcagaatccagctattctcaaaaaagaatttgagggacctggagtgccaggatggtctcttttcatccctgggtcaagatcctggtcccaggagtgagaatgtgtcccaaatacgtgaccctttggacagaaatttgggcctttcggggggatacctgatacccttgttttgtttcaaaattaaggacttgaagttgtatgtttctcagagtcttcccctagtagggctggaaattaataggtgatacacatatggtaagagggatccattaattaactgtagttcccatacctcttttgccaatgcattgccaaacagatggggattgtcctaaaaccttggggacaggacagtccaggtaagctgagatgcagcatgagtgtctggattagtccattcaaatgcaaaaatgtattgggtgtccaggtgtaaaggtgtgtgaaagaaaacatcttttaaatttaatactatgaaccaataagcatcttcagggacttgagttattattgtataaagattaggaactattgggtgactggaactaatgcctcattaactgccctaagatcctgaacaaatctatattccccgtttggcttattaacaggaaaaatgggggtgttacgttgggactgataggattgcaataatccatacttcattatcaggggatggatgccccttggagccaaaggtctaaaaggatactggatttttctttttttttttttttgagtcagagtcttgctctgttatccaggctggagtgcggtggcgcaaggctcactgctacctctgccttccgggttcaagcaattctcctgccacagccttctgagtagttgggattacagatgtacaccaccatacctagctaatttttgtgtttttagtagagatggggttttgccttgttggccaggctggtctcaaactcctagcttccagtgatatgcccaccttggcctccgaaagtgcagagattaaaagcatgggccaccacacttaaaaggatatttttttccccatagataattaacactgggtttcaaaataacctggactgggagaacatttgcagttcttccaggaactaccatgtcacaagcagacgggtctacttgagaagtaatatttgatggaaggaatgacttttctttatctgtgttaagacatgaacttagagctaggagaagtgtcccttcccagcctgtggccttctcttgaggtgctccaaattgaactgcagcctgttattgggaaagtaagtctcttcccagcaaaggaataaggcactcaagactaagcaaaaatctgtggaaaaacatggttccccacagtgcaactaaaggaatgggtgaatctcctagcttttagctggtcatcaatcctcattacagtacaggagtgggaagacagtggcaccaaggactagatcagaactgagaaggcggctcgcatatccaataactcaatatttttacccgccatgtcaagaattacctgaggctcttctgtagagatggcaaggtgtctggtggaagctgtagggaatcttgggccctgtcagtcctctgttctcttagccattaggggtccaagaagctcagactccgtttggagactgaggcagtctttcctccagtggccctcttgcttacagaaggcacactgattccagcctaggggatgatgagctggcttttgtctgggcatcccaaagccactcttgcaacactttctgaggatgggcagctcaaaagcagtaggaggctgaaagcagctgcaaacaattgcattttttggctatttcttttggttttatcctcttcctctgccttgtccctattgttgtaaactccaaaggccatgtttaagagttggctcatggagtttggggtcccattcctgccttttgtaacttcctcctaatgtcaaggatagattgagtaatacaacgcatgcccagaagaccccacccttccgggttgtctgggtctacattagtatatttcctgagtgcctcaaccaagcagccctaaaacagaatgggattttcatccttccactgagttacttctctatccttgtcataattaactggcttaatcacacaccttttcatactttctattaaacaagttagcatgtgatttctatgttcaagttcttgggaacccttctggtaatcccactgagggtctctatgtggaactgcatctccccctacataaatggtatggccttggatatgagcagctactctaactgcatattcacaggccagtacccagaatccctctcttctcctctataatacaggaagaggacaataatatttgcaagttgtgccaagttaaatcaaaggacatcatcaacctgacaaactcctctataaacttccctggatccttcaaaaaccagccatatttctccttgaagaaagccaatttggacaaaggaaatggcacatatactctgattgttcccctatctctgccagctaactccagcaatggacacagattcaatttgaggggctgatagagagctccactcctggtggttctggttgggcttacttccttgggcagtggggatacaggctggagctagctaaataaaagggagggttttctgatgacattggggtgaaatcccacactggagaactggcaggacccctcgcagaactgggggactgagaagaccctggagagggcatgggccctccagggggtgccgccaggaagggagcatcgaggatatcccacgcggtttcttggtgcctggaagtaacatgagccagacacatcctgcagttgactcttaagtcagaatcctggtagggggccgtagaagcctgtacgtaaggaacttctccccattttccttcctttttactgaataagtccaattgtaaaatagtatgataatgtaaagaacaagtttcaggccaaatttcttgttctcccaagaaaattgtttctttttctttgagccatctcatttgaatttgctccaattgccttaaagacaccctagtggggagtcctttgggatgctcgcctttgtccccatgtctaacaaggatctctactacacccagaagtttttctaagtctagcaaaagctcagttactttccctttcaaattcccacctcctgcagagatgtaagtacagttagcaaagtgttatgaaagtagattatgaaatatgaatgcgaagtaaaatgatgggtctgaattccacagagtgaagaaagcattttagtttgggcaaagaggggttaaaagaaacaaggtgatcatggaagggaggaagggaaagcatgaacagcgttgtccagactgaggtgccagaaaatctacccagcagccacagagactgaggaaaattatttgggcaaaatgtttggatggctgctgcttgtctgccactatgggtagttgtcacttgggccaggggtccaggaatccctggtccctgtgaccaagagttcaatatgggcttgagcaaagtcacgtaggagggggcccacaactggctgttatggaaaatcgtaatcttttaatttaagggcggagaagatgacatccacactcctccagcgaaggagctctaatccacaatcctatagggaatgtcaatgctgaaaaccccagagcatccagggagaggccaacagtgacagtggaactctcaccacaacgaaatgccaaaaacccagagtacccaagtatcagccagtgatggtccccacactgaatgctgaaactgcaggggaggcaatggtgaaccccaaaggccaagttaggggccactgaacaatgtgactttggcatctcagggtcagcacagtaagggacttttcacgaccaagtgtcctgccttaaacagttcttgactctgtcctgtcctgtcctgtgttatatcatgtcctgtcccatcttgtcttgtctttgtggtcaccagatgatgcaaggaaggacaaccccaaaattggggcttagccaaggagagttcttggctttgcccaggtaagaattcaagggcaacccagcggtgaaagaaagcaacttttgttaaactggtactgcttctcgtggaggaaggctaacccatgggcagtgtgtgggttgctagctagctgtatttatttagatgcttttaattagatgctaattaggaagtgggctattcagaactttttggaaaagggatgaggagtttccagaagcatataaggtaacttcctggccattgccatggcatgttgacatggcatttataaactgtcatggcactggaaaggagtgtctttatgctaatgagcagtgagagcaactagaggtagcttttgtctccatctgctggttttggtcagcttctttactgcaccctgtttggaccagatcctgctctgatcaactgggccacaaccgcaaataagtcctgccactttcctacctcagtagaatctctgccaaagaatgatcttgaaagtttgctgtttactcatcatctggaaaaatcttcctgtataggccaaattcccacccttgagatttctgaaggaccaacaagtaaaaacagtatactccaatgggactgttagatttcaactaacttactctcctttggatttctttttctgaaaataaattcttcacacacactgacttgtcttttgcaatccaatgtaaaagtgggacatcttcttcagaagctttgaaacatacaaattagcctcaaacttacctaccagacttccaggctagaaggctgattcatgtaagaaggactaagaagacacttcacccatatcctgggtaacaggaggggatcctttagataggtttgtacaccaggctggtaacctacactttcttctagcagtgagaggtactgagatccgtcaccccctcctgcaaggccaagacccagagagagccaaattttagcctagaattcagccagctcttcacagtctcctatgttttacattttcctccacaatcatttactttgaaagacttcaaacctatagaaaaattgaaaaaaaaagaactcctctacaccattcacccaagttcaacagttaacattcctttaccttttttctctgtctacacacacctacacacacattcatatttcatagtaaatgcagaccaaaaaaactccacttcatccctaaatagttcagcatgtatttcatgagattaaggacattatcctatataattataatacaattcaattatcaaacctaaggatattaacatttattcaataacattatctaatatatagtccagatagaaattttctgtttagaaaatgtcacatctatacacatatatgtgcatgtatatagatatttatgcatacatagtgtgtgcatgtgtgtatgtatgtgtatatataacacacatgcacattacatatgcataaatgttttaatttaataatatttatatgcatcaatatcttaaagatatatacgtatcattagctggaagctgcctctatccatatattaaaggtttctccatatgtagtgaactgtaacctaactggatgtgtaaacaacctgtaacctactcttgagccaatgactgagttttagccaatcaaaggtggccaactgttcaaactgggttcaaataagacaaactcagagctgtagccaatccgattatttttgtacctcacttctgttttctgtaagtcactttcccttttccatccataaatcttcttctaccacatggtagcactggaacctctctgaacctattctggttctggaaatttctgattcaggaattcttctttgcttaattaaactctgtgtgtgtgtgtgtgtgtgtgtgtgtgtgtgtgtattatatattatatacacatgtaatatatatatgtatgtgtatatataatatttatttaagagagagagagaagtgacttgtggtactgatgttgcttccctaggttccaagtaaagttcctcaattgcactttacttacctagagctgtccctccatttctttgtccttgttgctaagtttttgaagtggataggctagttatcttgttcaacatcctgcattctgatcaaactaaacatttttggaaagaacagaatataggaatttgtgcttcttaccactcaacctgtcagaaagcaagtgatgcaagaacaaaatattgtgaatatgtttacatcgaaagtgttaaagaaaactcagcatctgccagcaagtttatggcgtgccacggtggtatagtgattggcactttgtgttgtgaatgcagaaccttgattccaatccaaaatggcagtgtgtggcatctttttggggagaaactgagctgtcttttggtttgttttcaatccgtgcactgactgagtcctttagcagggtttaccactgactcctgcaatgcagtgcagtcaggcaaaaaggagaccccacattgcacatacctagggcccaggacatgccctatgtctcaccattgagcagaaaatatcccaaagggtaaaatgtcacctttcaaaccgccatgttggtagcttccactaatgcagtggtgtggtcataactggtttttactgttccttacaatggctgcaacccttatttgtgactagagaacaaggcttaccactgaattgccagcatgatacagccagggccatcaaaaacacacctgcactagatcattgggaactttggaggtgccttacatctgggcatgcattgaaccaccacacaaggtgaaatgcctcttctcaaagaggcttgcctgcagtttccactaatgaaattgtgagtcatagctgttcttctgtttgagatattaggagggattttgtggggggtgaggggggatgaaagtgagcttttactgagtttaaaataaaatccaaactccttgccatggtctacactggcttgtctccatcttccatcccccaccccccatgtttatgctaaagagcagactattgaaatgtaattcacacagtgtaaaattcaaatatattaactaggacaggttattaaatattgacaaatgaaatcatcacccagatcaagttatagaaaatttccatcatcccaaaaatgtctgtggatgccaggcacggtagctcatgcttgtaatcccagcacttgggaggctgaggcggaaagattgactgagcccagcaatttgagaccagcctgggcaacatggcaagacccccatccctataaaaattttttttcaaattcaaaaaataaaaaatatttaaaaaggtccaagagtccctttccaggcaatcccacccttctccccttggtttatcactattctgatgtttatcaccatagattatgttgctctcttcttgaaattcatataaattcactttttgtgttagctttttttcacatctttgaaatgtatccatattattatatgtatctagtttatttgggtgtaactggtgagtgttatccaatatgtgaatacaccactgttgatggacaatttggttatttctagtttggactattatgaagaaggctgctgtgcatgaatattattgtacgaatctatttatcaacaaatattctgtgttttcttagattttgtatttgtctctatttggcatctattcaccgcagaacaattataataactatattttcttattttctttatttttttcttaaaacaatttattgatgtatgcctggtatactaaaagctgtacatatgtaatgaacacaatttgctgagattggaaataagtatggacacattaaatcatcaccacaggccgggtgcggtggctcacgcctgtaatcccagcacttttggaggccgaggtgggtggatcatgaggtcaggagattgagaccatcctggctaacacggtgaaaccctgtctctactaaaaacatacaaaaaaaagattagccaggcgtggtggtgggcgcctgtagtcccagctacttgggaggctgaggcaggagaatggcgtgaacccgggaggcagagcttgcagtgagtggagatcgcaccactgcactccagcttgggcaacagagcaagactccatctcaaaaaagaaaaaaatcatcaccacaatgcatacaataaaactattcagctgggcacagtggctcacacctataatcccagcagtttgggaggcccaggctggtggatcacttgaggtcaggagtttgataccagcctgcctaacatagtgaaactccatctctaccaaaaatacaaaaattggtacagaataattatacatgtttataggagtacatatgatattttgatatatgcctacgatgtgtaatgatcaaatcaggatgtttaggatatccatcatctcagacattttatcatttctttgtgttgggaacatttcaaattctctcttcttagctcctttgaaatgtacaatatactgctggtagctgtagtcaccctactgtgctgtttcttttctgagattccacctaaccccttgatgttccaactgctgtggttgtctaaaactttgtcctctgttcctttaatctaggaagacagtttggttttgtattgtaatttagctaatccaagtaagggggagcaaagtttgttctataaacgaaaaataaaatcctaagtcccccaactgactaaatggaccccccgttggccaacgggaccctaggcaaaccttataaactgagtcccaggccaagaaggaacgggaggccagacaagcctcattatattcccacccttttgcaatttagacaaaactgaccaacattaatgttatcatggagatcataagactgacggaacagactctttatggcaataagacaccaaattataaataggacttaggaccattccgggcaaggattaactcacacaccccatatatgcaaagaataaactatgttctaactgccacaaggattttctctagcagctaaacaagcactggccttgagaatagggagtgttgaagcacttgctgctcacccctcaccagataccgaaccccgctgttccacaagccataactacagccttgactgacaagagactgatttcagtaactttcttctgatgagaagaccagcgaccatggactggttctgtcagttttacagtatctgtgcatttgagtgcctttgtgtcctgaaaagacctttgtgtatagggcctaattgtaatgcatttaaatgctaagtatccataacaaggtgaacaaggttgtatattacgtgaatgtttgttcaataagcatgcatcaggaccccttcacaaatattcataaatcctcctataacttgttgaatatgtattttaggcccacccattcaacttaaattcctgtcttgcccctccctccctcaaagtgcctgcttctgggcttcccgcgattcccagcctgtcaggatgaccaccttacatgctgtaaccctttagaagaaataaattctcctctgtaagctcacaaattgtatggtttttcagttaacagccctctgctgaaagtttgcaaaatgggatactcactacctgccattcttccatatgtccgcctgcttttgttcagtcttccagcaccttcaaattatataatatatatatgaaataaatttttctagtttatagtcgttatctgtgggagagttactctgaaagcagcaagaagccattaccagatgcagatctcattctgtcagtaatggcaacccagcaaatagggcaggagccccacccaggtgtggatcaatgcatggctgtataaccttgaacaagctgcttagtcgacctctgaagtcagtactgctgtatgagaaatggagatatgaaaagaacaggagtgctagggtgcccaagggagaaaagagtaggtaacaagattttcggtcaggagcatgagaaacagggagagggtcgccattaactccccttcttcaccagagttttctggcacccaagactgcagaaactctcctgcagtgggctttggggcacatcgcaagttccagtaacaagggctaaggtcgcccgcttttggagaccttacaaagcatgtattccctgaccaggaatcgaactcgagctgcaggcggtgaaagcgccgaatcctagccactagaccaccacggaaacaacagcaagcacttttcattcctcttgccttccaaaggtttctccaaaaggtgaacctgtctgcaatgctcacgaagcccgccagatgcacaagtcaaaactgatctagagattctgaagtacgctgtgctccttgagaagtgcggagccactggaaccacaagcagcttcagacaggaaccaatgaggccatcaaaaccctcaacagaggcatctgtgagttcattgtggtggctgcagacaccacgctgcaagagagcattctgcactcccactgctgtgtgaagagaagaatgtgctgggcctgcctggaatgtttgcgcactccaggcgggccctggggcgggcctgtggggtctccagtcctgtcatcacctgttctgtcaccatcaaagaaggctcacagctgatccagtccattcagcagtccgttgaaaggctcctagtctaaacctgtggcgtctaaacccgtggcctctgctgcacaatctctgctgactcctccccctgaggttattctcagctactttctattgctataaaatattatagtactaaatctggtttctggggttttgtatagtttttgttctgttttacagggttgttttcccccttctccatgcccaccctttctctgccatcctgcatcctcttcaactctctattgaaaaatgaacaaatgttcagaacagaggaagtagagtggtggcaccatcaaaggcaggaagggccaggagaacctgatgggagcggggatacagacctggttctagcttccagtcttccagtcactaactttctgctgtgtgcagggcacaatggaagtaaacaccacccactatatatcccctgtgcctggcatacagaatcattcacacatgttgaccgaagggtttcctttgcttctaggggattatgtatcattttgggaggaagcatgtattctgtgaggttgtttagtttatgtccaagcgccatttactaatgtatccctgctctttgctttcggtatgtatgttcttcctccacctgacaattgtgcccccaatggtggccaggcagcagcataccaaagagatgtgctgcaagatttcagaggtgggtgagtgagacatgggaaagtggactcaggtcttgaaagagtcaggagtggccagggcaaagaacatgaactggtgctggaatgaaggattctgggaaggttgtggagacctggctggtagctagagcagagatgatggaatccaaggaaacaacttctctccggtgaatcaagatttcttcagtggacacttagtcccagctctgatagcccttacccctgtttcctgccacagtgtgggtcatatgtattctttatcatatgaggagagtgctaattaatgtgtcatttattttgtgagcatgctaatacatatattcatattccaatttagtgaaaaaaaactgatctagagatgccccttttcgaggtgacagcatggctctggagagatggccacaggaaccatggcagtggaccaggttgctgggagaaggcaaaaggggaggcacccaagctgagaaggggctaagcactcagcccctgggaccaccaacagcaggcctgagacacatgcaggaaaccagacagcctggatgaaatttctttcaagcaaggccagtggtccctgacagaacaccagaggtttccccctaaatcctttcgcatctgtaccatttccatcttagttggagctctttgttctcatccttgcaatacgcagagaaaaaaaaatcacaggttgttgattgtttgaagatagggtattgctctgtcactcaggctggagtgcagtagcatgatcacggctcactgcagcctcgaacatccgggctcaagtgattctcccacgtcagcctctggtgtagttgggaccaaaggtgtgccaccacagaggcagggttttgccattttgcccagaatggtctcaaactcctgagctcaagggatcagcctgcctaggcttcccaaagtgctgggactacaggcatgagacaccttgcccagccaaccagagttctttttgatgccgatattttactcggactccacatctaggtaggaattcatgttttcaagtacggacattgctctacacaatcctctcctttcctgatcactaaattagagtaaatcactgtcctgaagaaggtacccttgggagagtgggttggcctgtctttccaccctttcttgactctgccctcaccttcaagcctctttctggcctgtgttcaaggtccagaggcatgcttaagacctctctgtgtggctcttcttgaagagtcaggaaccccatacttcctgttcagcgggcagagaagcttcaagccgcacagttttgggtatgctaggatcccacaaggcacagatgtgcagtggcccacgaagtgagtttgtgggtctccagttacctgcagccctttctgctcctgtaggttaaagggcaattgcctttttttttctgtccaggaaggaccccagaatgttctgagtcagaaagacagtgaatcctctcctctgggtcagtggggagggagagagagagatttcagagggaagaaagcagaaaaagatgtcacaaaattgcctaatcaaaagttaccatgatgcctgcctcatctggaactgggctcccagtctctagtgagggagacatagtccagtccagtcccagtctccagtctgagccaaagcagaacaaagctggacactgcagcctggcatccaacgaacattttgtcactttccccagggtgggagcatttgaactttggatgtgaaggaaacatggtaaccactgcagtaagaagagcaactgctggagaaaatggcactttcttccccaaatttgtttttacactcatgtctaaggaacaccttagaaaccacattaacatctttcagcaaaaggaaattctgcctgttgatcttttgctgtgagacaaacttgaaaagttcacagacactgcctttctctgaaaactgcccttacctctttgttataattcacttcaagatctgttgagtaggaacatcaaaaatgcaaataaaaagtttcaagtattatgaaagaatgcaataaaactgcctttaaaaaaaatctcaagatggaggtggagatcctgtgatcatgaaatctgaataggctgctcttgtgtccttcagtggtgatggctctgaaacccttgtgttttatgaacttcatgccctggtcttcaaacgaattcagtgcaggccaagaagcacagtttggcctgggttggatgctctatattttcaaagagtgaaatgtcttgagacacagcctttgctatagtacctgctaaaacttcaacgtgtggataaatatagcttacattgaatcgaatagactcagcgagagtggcagtgaaggatgccctctggaagattcgaggtgctgaggccaaagggctagcaaggaaagagcgtgcgggtcaggcccttcaacctggtggaagagcaggcagggagggtcctatggttcctgggaggacccgaagcatgatcgcctgtcaagagccaagagccctaatggccagcgccggggaaagggcccccgaggggcagtcagcagccctgcaggggcggcgttcacactcctgtgtggcacgggacactcatggctccaccagctcctgaagcttctgggagccagagagtcagcagggagaatcccacacacgggcactcagttcctggaaaccctgcatgagatgcgggatcccgaagccagattgggggtccctagggtcttggcttcggggctaggcgcggaaccgtaaatgagggttcagcctgtctgcctgagggattgtgtttcctgccgtatttatcactcaaattttgaaaagcagtcgaatttgttatattggaaaccctagtagttaaaaacagcagatggtaacatttcaggaatatgtcttgtgccaggaactgtgaggggtttctgtagtgtagtgattacatgttcgcttcacatgtgaaaggtctcaggtttgggacctttcatcatcaacatgatgaaaccccgtctccagtaaaaatacaaaaattagccaggcgtggtggtgcatgcctgtaatcccagctcctcgggaggctgaggcaggagaattgcttaattccaagaggtagatgttgcggtgagctgagattgtgccattgcactccagcctaggcagcaagagtgagactacgtcttaaaaaaaaaaaaaagaaagaaagaaaagaaaacagaggactttaaaaccgttattatgtcaatattctatgggtccaaagaattaagcagaggtatcaaacatataaaaatggtcagaatcaaactttggagattaaaaactacaacatctgagataataaattcactggatgcaattaacagcagattagacactgcagaaaaaaagattatgaaacacaaagccgccgggcaccgtggctcaggcctgtaatcccagcactttgggaggcggaggcgggtggatcacgatgtccagagatagagcccatcctggctaaaacagtgagacccccgtctttacaaaaaaaaaaaaaaaaaaaaaaaaaaatatatatatatatatatatatatatatatatatatatatatatataaattagctggacatggtggcgggcgcctgtagtcccagctaatcgggaacctgaggcaggagaatggcatgaacccgggaggcggagcttgcagtgagccgagatggtgccactgcaccccagcctgggcgacagagcaagactccctctaaaaaaaaaaaaaaaaaaaaaaaaaaaaaccgcactgaggggaaaagtcaatgtgaaattctacaaaagctgaaaattcactaccaccagccattaccacaaaaaaaaaaaaaagttgaaggagtcctccaggcagaacgaaactgacatcggatgaaaatctggttgtacaaaaaaaaaaaaaaaaaaaactagacatgacatctaatagacgaatatataattttaacatctgactgtttagctgggcgtggtggctcacgcctgtaatcccagcactttgggaagctgaggcaggcagatcacttgaggtcaggtggttgagaccagcttggccaatatggtgaacccctctctctactaaaaatacaaaaattagtccggtgtggtggcccacgcctgtaatctctgctactcaggagtctgagtcaggacaatcgcttgaacccgggaagcagaggttgcagtgagccaagattgttccactgcactccagcctatctggaacctagtttgatctggagggatcttattttataggaggcttggagggggaccttttgctttgtgtacttataggatgcacaagacacaagggaacaatctctcactttttaaatacagtgataggcctgaggagaaacaactgcaattttttttttttttttttttttaatgagatgggattctcactggtcttgaactgagctcaggcgaggcttcccctacgtcggcctctcaaagtgttgggattaataggcgtgagccaccgcgcctgaccacaactaaccaacatttaaaagcacgtccctgggtaggctcgaaccaccaactttccggttaacagccgaacgcgctaaccaattgctccacggagataacctcagttggtcgctttcatctcaacatagattaagcaatcactaaactctaggggttgccattcgctttctgcaggacaactgtgcagactacaaagcttcggaaaaccggagaggctgagtcgactaatcgtgttgttgcacgttagaaacgcttgcattgcctgactctgaaaccagaagggcggccgaatggccttcaccctccattaaccctcgcctccttcagaagccagtgcctctggaaatgcctggatctgcgaccccagcctgagcctagtagggcccaagggaagctgaacgccccgacggctctcatggtaggtagctctttctgtttttttgcgccgccttcaggcaatcatctactccgcttgctatcccctcactcaactcggcttcagtagatggggttggtggggcgggagtgggaaagaggcaggggagtcaaaagggaaaacctgaaaagaaggagggagaagaagcaggggagaccaggacgagacaatgggacagcccaggatgccggtgcagagggcagcggctggatgcagagaagatgggacacgtatcagaatggactggagaagacgtgagggaaaatcacaagaacctgtagctgcccaagaataaacacgtaaaaatcgcataaatgtttttacattaaaaaaaaaatcgggagaccgggcgcagtggctcacgcctgtaatcccagcactttgggaggccgaggtgggtggatcactcacttgaagtcaggagttcgagaccagccgggccaacatggtgaaagcccgtctctactaaaaatacaaaaattagctgggtgtggtggcgacgcttgtagtcccagctactcaggaggctgaggcaggagaatcgcttgaacctgagaggcagaggtggcagtgagccgagatcgcgccactgccctccagcctgggcgacaaagcgaaattctgtctctcaaaaaaaatgcataaataaataaaagaggggtggggaagcaaaacgacgggcagtaggtgtggggcgcattgggattctatagtggttagtaccctgccttgtgcctgcagcaacctctgttctaatctgaatcctggtacagtcagactctatcttggacccactggggcgaacccacgagtcttttggtttgcttttaattcctgcaccagctgcggcctttatctgcagccagaaagcagggtttaccgctggccccacagcgccatacggtctggggaaaagaaggaaacccaatagtacacaaacaaaggcccaaagagaaaccttccaagtgctctatgcctcacggtttagcagaaaatatcaagcaactctcaacctagctggtctgtagcttccacaaatgaaatactgtattcattgcagcctttctggttgagatatttcaaatatttggtggagcttttaatgagacggagagacactctcgagtgtggaagaaaaacatgagggggtgtgaggataaggcgactttaggacagaaaaaacaaagagacaaggaagccacgtaaacgttttcgggtaggcgtgaggcgatgtcagttttgaaccccgtttatgttaggtagagagcgcagccctcttctagcacaaacaccgtttcccacattgaagaaatcacagagatcagcaactctagagtgcgatgaagaagcttcactctgggagaacccccttcgtgaccacggtctctttcctgccaggtaagtgggaatgagcgcatgccctgcagggacagcacagcgtcctcgccctggtcggacgctcagggtcaccaccctacccactgcccccttcgccattcttccaaaccactctctgccaaagattccaccgacagtcaccccacacgacaacccaggccgcctttcagcagtggctcccgccccgcaaccacgcgccctctcacccccgcggttctgcccgccgcctctgtccagtctgtgcacttcacctccctggctcccgctctcccctgagcttacagtggacgcggggttcttccaaacccctcttgggaatactgaatggaaaagggggagcgtgcgcaagtgcttggtagagtgtagacattgtgggatttgactgtggtaccatcgctttgacgtcctagtgctgatttttacacctgcattctgcttagggcactggcaacagttttccgtttgtgcctactccacctgctgtctttgttgggtcagcgaacatcgcctccctctaccgctcaatcagcaaaagggaccgcccttgaggacctcacccgccgctcactcccctcccaacttcgcgggcatcgcctccggtcgcctcttccgaaggcctaacgagcatgttagctgcgaacggaggtgaggaggctccgctgactgaccggtgcccacgtccagggcacgcacaaacgccatgacttggcttggcctctctcttagttattcacagctcagcccgataggcacctctggggcggcgacggcaaagagggtgcgcttattaagtgcagctccacggggactggcctctctgcacggctgtgtacacctgagcgagacgctcagtcgctctctaaagccgcttctgcggatgacagacacggagataaacgtgagaggtggcccaccacgacttgccctcctttgcccgggtttgcccctcgctgcggaggctgttctacatctggcccttggagcaggccggctgacagcgtggtaaaggaagatttctgcgggagggcggccagtgcaaaacaattccctgaccgggaatcgaacccgggccgtggctctttcagcaccgaatcctagccactagacaaccatgcagatgcggaaagctgctttctctcccttcttcgacctgaagcgacactttcctgtgctctaggaggacttgggtcttgtgagagtcgccctttgctcctggagtcgtctcacaaggccgttcactccctgctttcttcaaaaaaagaacctgcaggcgacacaccaaggactccacgagggagtcctgagtactggagcgagttgcggccacgcggccgcagctcaccactggcctagagatgccctttgcgaggcggcagcaactgacaagatggtcgcgggtcgccgggtccggagccgcccaccaggttgccaggaggaggcgggagcggggaggcgcccgaggtgagacaggggcaccctctgcatcataaaggacccagaccccggcaccctcaacatcataaggaatcagacggatgcggaaaccgagacgggctggataggaaactctttccaggaaggctccggggcactcaactggtctccaaccttcccctgcaacctgtgacgcctgccattttcccattttaggcgatggcaacgcaacccctccgtttgctctgggcaaaacttcgagagttccctctgaagctggagctttttcctcagatccaagatccaattggtcaccaattcgtgatttccgtcggccaagtgcgtgggcattgatctacacgcgagtttctccacctctgccgaatggctacttcggggtgggggaggggccctcccgccgtggattgcaaggtgtttagcagcatctgtctcctccgctgactagacacatgccagggggataacattctccctcccgcttcccccagccgcggcctagtgtcccagcggggttgggagaggcatgtgagggcgaagttgccccctgttgagaaccattgctgcgcgtagtccttctctctgaacttgtgcagaggactctccaggtgaaggctcaagggtggatccagctcgagacaccctcgctccccctcacagtcggaccttaggatttaggctttaacatctccacatcatgagattcgaaacctttaggtcttgtcttccgttctgtcctccaaatcggcctcttccgagcctgttgaccagggccagccgggcagagggctgggctcgctcaacgaggctcctctcgcacctcctggagcttcaggcttctttccgttgcagagaagctttatgggccaattcgttcggcatccccgggggcaggtgcgcggtgcgcggggaagaagaggatttgactgcggttctccacccccggcgcccaacctccaccccggtgcgcgcgctcttccaggctcctgctggtcccacttgccaggagttaggtctcaggtcagcctgagctcctgagacgcccaggcccggaaagacacgtaggggaaaccatctgctcacttctgtcctgtccggaagggatccctttctgacgggaaagaaaggcggtgagtcctgtcctgttgagtaggcggaagagagatcaaagggaagacaagaaaaatcctgtgagttttcaggatctaaagttaccatgaggtcgacctaacctcctctggaggtcctcccggtcctcccgtggctgtcgaaggtgaatctagcttccgtctccagttcgccaaggcggacaaagccgacgacaatgggcctgtccactatcttctttcatatgcacaaaatgtcagctcttcttgtttctaacttgcaacatcccacctgatgaccagctcagcaaattagagaccctccatgggattccatctctgtcttagttcgggcttccataactatataccataaactgggtggctaattcacgacagaaatttatttctcacagttctggaggttggaagtccgagatcaaggtgccaacatggtagggttatgatgagggacttttttctggttgtagactgccaccttctcattgtatcctcagggggcagagagagctccctggggtcccttttatagtggcattagtcccactcagactaacgggactaaatccagacccagttattgcaatgtgtgcaaaagaacaaggacttgtactatctgacttcaaggcttactataagctattacagacaaggcatcaggagggacaaatagataaacagactgagttaagagacctgaaactgatccacagccatacagtcaataaatgagctttcaatgaaagcagttcaatagaagaaaataaatcatttcaattaatggactttcatatggaggtgggggagaccaacaatgttattctccctcacactacatacaaaagtaatttgaggtgcattatacaccaaaacttaaaagttaaagatataaagcatttcaaggatactctgtaggtaaagattagcctaccaacaagtaggacactgaaaaaatatatataaaagacatgataaattagacttcatcaacattagccataccttctcatcaaaagataccactaagaaagtgaaaaggcaagcaagccacagacagagagaaaatagtcacaaaacgtatctgacctccacatcctgtaattagaattattgtggtctggtacactgcacccagtttctgcaggagtactttctgggtgtctctaatgagtaagagagggccccatgggatattcctacagttcccagatgaacagtgggaaagactctacgttgacaaaccccggggacctgaaaactcaggtcctcaaggagggtagaggatacctggaccctgacccagacccctagatgggctgtgccaagagacccagcaagggaagggattccctcctgcctcaggttctctgttcttctgtggttagaagacctgaacccaactccctctccaagcagtggagatagggcttttccaagggctggggatcttgctgtcctaaggacagctgagcaagggggtcgaggaggagcttgggtggtggaggagaggaaaccgggtaagatgtgtgaagcagtcggctataccaggcacagagaggacccactgggacacaagagcctgcatgtgaagccaggccttgggccaccttgttcctcaaaggggtgcttacttccatgggatcttcaaagggactgtggaaagagaagccttcagcccacacctctgaatgcttttccaccacagcatgccctgtggcctgtatcctgctggtgtggaacagtcagacccctgcagggctgcagagcctctgtactgggcggcatcccagcctgagtgccagagctcagtgggcaggcccccgagcaagcagagaggagggcaccttttggacagaacctgtgggacaagagcgacgtctcatcctttcaggttcctcacaaaatgacagtcaggaagatcagggtgcagacctgatttcccacgaagggctgaaagcagacaaccggagggagagcagcacctgggccaatgaggtagaagacagaagaccacagtgtacttctgccctcaacctcaccccctcccacctacatcctccacaccccctgaccaccttcttcagaaacgtaataggaatcaagatcccccctggcctggttgctatgggaggcacagtggcctgatggagcctgaggcaggtgtgggaagatgtggattgtctaactggaggttgggagtccagggtgcagaaggagaagcttggagtgcaggatttggtggtatgtgtgtggcagtaggcactatgttctaattgccagtttttttttcttcttcctttttttctctagctaaacaagcactggccttgagataagcaatgctgaagcacttgcagctcacctattaccataaactgactgagccctccctacacaagccgtaactactgctttgattggacaagagactgatttcagtagttttctcttgataagagaccactggccgtgggcgggttctggacagtttacagaagctatgcacttgattgcctttgtgtccctgcttcaccttttgaagcatagggcctaattataatgtatttaaatgttgtctccaccccaaagtgaacatgggttgcatgtaacaggcatgtttactcagcatgcatgcagcaggatcccttcacaaatattcagagctccccctattccctgttgaatatgtatatgtggccagccagatcaacgtaaatcactattcgccctcccctccctggaaacctacttttcgggtttcagcaggaagctatgcctccccgtctgtcagaatggccacttgcaggctgtaaccctttataaaaaaataaaatctcctttctaaatttataaattgtgtgatttttcagttgacagctttcagttgtcagtcaagtcattgactgggaaaagtcatttgcaatatatttatttgaaaaatgactcaactcctgaatatataagagaactttcataaatcagtaatatagagctaagccaaataaaatcgggcaaaatattcgaataggcctttgcaaaggagaatttcttatatgctggaagccataagaaaatatgcttcatagtattgctcattaggcaagtacaaattaattccacactgagataccactaaccaatcaccagtgtgtggctacttttttttttttctctgagacagggtctctctcacccaagctggagtgcaatggtgcgattggtgcaatcttgagtcactgcaacctccccctcctgagtagctgggactacaggtgcatgccaccatgcctggctaatttttatattttcagtagagatggggttttgccatgttggccagtttggtctgagagcatagctacattttaaaaagttagtacaccaaatgctgacaagaatttggtgccacttcaactgtcattgctggtgaaaaaacattctagaagactggcaatttatactaatgttaaacttgtactcaggtcgtgacccagcaattgaagtacttccatgaatctcaagtgcacaaaaagacctgtagaagaatattcatcacaagaattcaataacaccaaaattgagaagtgatctatgaaactacgtggatatatctcatgagtataatgaacatacctgcagaaaaaaggccagatacaaaagatatgtccattcactcatgtgaactttaagaacaggcaattgtaacctatgggaatagacatcagaatagtgattaactaagaggacacagggtgggaattgcctggaaaggggctctaacaggcctttctcagatgatggcaattttctataacttgagctgggtggtgattacattcatcaaaaataaacgaactgcactaaagatttgtgcactttatgtgaactgtagtttatttactgttctcattgcttgaacccgggaaacgggacgttgcagtgagccgagattgagccatggcactccagcctgggtgacagaacaagactacatctcaaaaataatagtaatagtaataatttactgttctcataaaaattagcggatggggaatggaggcaagccggtgtagaccatgacaactagtttagattttattgtaaactcattaaaagctcgttctcgttttgtgtttttaaaaaatcccactgatacagccgttttctctaccagatgagactataaccgtattatttcatcagtggaagctacagacaaagggcccttgagaggcggcatcttcacctatgggaattttttctgctccattgtgagacaaagagcatgtccgagttttcattttggccaggccgccccctagtttacgcactgtgggctaaactccagaagctggcgcccttccgggccagcggtttactccgctctctggaggctgctaggattaaaggcaaagcaaacgacaggtcttttagctacaatcgcaggagagaaaacactactgtgactcagattagaacccaggttgcggcaaccacagctgcaagtattgaccactacacgaccaaaaagcctgctgacaaccattgtacttcttatatttttttatgtaaaaacactcatactattttctctgctttattctcgaacgtctgcagattttcgtgcttttctctctttcatgcgcttctccgttactctctccccattccgctacataatttaaaaaacatctcatctctcaggacctggccactgcctctacaacaagcctcctgggaagtctcgttgtcccatcgacacctctcccttctttcgctccatttttttttttttttttttttgacggagttgctctgtcgcccaggctggagtgcagtagcgcgatcttggctcactgcaacctccgcctcccgggttcaagcgattctcctgcctcagcctctcaagtagctggaatagcaggtgcacgccaccacattcggctgatttttgtatttttagtagagacgggatttcaccatgttagccaggctggtcttgaactcttgacctcaagcgatccatccgcctcggcctcacaaagtgctgggattacaggcgtgagccaccgtgcccggccaaatttcaggccaacacctgttgacacacattgccagacacacggaatccctcactgaacaccgatgggcccacaaaacacgcggaggccacggtggctgaagatgttagcaaattcggttcgcggtgtctggggtacagcctcgagggtccattggctacctctgtgcaaggaccactctgcgcaaggaccagtcaccgctgctctcctcatctccattgagattctcccgcacacacctcccctttctttgggccgctgaggcctcttggacctccgaggtgattgccccgcccgcagcttctctccttccgggagcttcatttcttgttcctctccgtagtggctcagcggtaagcccaaggtccagcacacgaatcaggaaactgatggttcttgggtttgcaggaatccgcccagagaacagatgaaagtaacaggtaccaatatcaaaactgcagtgactcaccagaaacactacgtgcttgccactttgcttagcggtttgttgagtccaacaactgcgtgggtcccgggttagtctcctgaatgtcttttgctgctactttggtcagcgttgttgtcagtttaccttgtggtggccaagcccttaaatgcactattaggttatgcagtgtaattctgcagggcagaagggtaaagagccatagtgaagagcaaaagaacctcttgccttgaccgggaattgaacccgggtgtcccgcgtgtgaggcgagaattctaccactgaaccaccagtgcctctccccagcaacccttggagaattatcggaaagagtatccagaaagacttagaaacttccaagcggccttttcaagtgtcgactcaaagctaacaaagacatccaaaccaaatgtttttataggaaacttttactaaacaaagttataaatatcaaaatagctcatttgtcggatcaaactcttaactctgaaaaaggtctttctacctgcattacatacccctataataaaacgtcacaaattcattcatgtttcttttttctaatcctaaatcttcaattgtcaacgtcaaactgctgccttagtggttctgagaaggtaacctaactggtagcttaggtaagtaaagttctaatccagggaggaaataagaagcagaagcagaattagaattagaggaaagaggaaataaaaggacagaatcaaggtagagataatgaagaaacaaaggttggtccactgagttagtcttttgtcgctggtttttttggcaaaagagtaatgatcggtcttgtaaccataatactgttatttgtctgcttgaagatgtataaagcatttaaaggaaatgtgatataaaaagattaataatgcctgcagtcaatatttcattgttagagagaatccaatttcctaagttaatatgctttgatgtattagctatgtaaggagtagactagtttaaggaaatattgatggtcaaaatattaacatattagtcttttgatgaagttcaaatagagagatttcttttctcaattttccctggagagattaaactgaagagaaaaattcagagagcttgccccacatgttgggtctgtgagtcattatgactttttcaaagacaggagctgtgacatggaatcatgcttcttctctagctgagaagccaagctaggtccaggctgggtcataaacttgagcccaacaaggaaatcacccttcacattgacctcacagagctttgactgttctctgttctttgcccaacacccaagacacacaccagctctggccaacaaaccttaacatattatctatatcaaccagagctacatttattcccaaatctccttctaaaatacaaacctgtactttctactctcaacttctaaatttacaaaggcctcatatgcatctcagagtcacagatgctaaaactcaacacaccggtgagttccctgtcagcaatatgtaccaccctctacctcaaaacccaatgatcagactcaagcacagcatctcccaaagagtagtgcactgccctgggtgtttcaatgatcactaaaacctgtttctagccctgcctagcacacttatcctcaccaccatctatcctatttgccaagccagatctttctttggataaactctctcattttcataacacaacaatttcagttcaattcaaaaaaaatagcgtttaagtttattggatactccacaagcttactgccactttattaccacacttttccatctatcggctcttgcatccattaacataagcagacaaaaaactggactcctggccaggtgcggtggctcaagcctgtaaccccagcactttggaaggccaaggcaggcggatcacgaagtcagaagattgagaccatcctgactaacatggtgaaaccccatctctactaaaactacaaaaaaaaaaaaattagccaggcgtggtggcacccatctgtagtcccagctactcgagaggctgaagcaggagaatcgcttgaacccaggaggcagaggttgcaatgagccaagaccacacaactgcactccagcctgggtgaaaaagcaagactccacctcaaaaaaaaaaacaacaacaacaacaacaacaaaaaactggactccctacagccagtgtagtatgcaccactcacttgccacactgtatgctgagtgacccttccacagcttaaatctgcacataacttcagcctagaaccatataatgtccctttatttcttcagtacaatgattaataccatattctctgtacccttcttcactctatgctcatcattctaacagctcttgccaatactcaaatccaggagcagcaaactacttcacatgtcacaaacttttcacaggttcacaccagtggattccccagtgaaccagctgtcttaactcaggcttccataacaaaataccacagactgggtggcttaaacacgaggaatttctttctcacagtttgagaggctgagaagtccaagatcaaactgccagcggattcacctccttggtgagggctctctccctggcttgcagactgctacattctccttctgtcctcgcatggtggagagaaagagagcactttcgtctttcttctgtttcttataatgacactgatctcatcatggagatcccatggtcatgacctcatctaaacctgattacctcccaaaggccctacctccaaaataccttcacattgggggttaaggcttcaatatataatatgaagggaacacaaacatccattccattacactagcacctgcatttgcaatccagcctctgggccaggcttagcagtgtagagcccaaggcttcaattgacaggatttttatgctctcatgctctggctccttggctccagaagcttctagaaccagtagggtgatacatcctttagcaactatattgtaaaacacatggtgggtaaaagagtgccctattaagtattttggttatgcccccattagtgtgcttggctcaatatattaatagtaagtagtggttcgcatccaccctcagtaccgccctctgcagtcatcctgtcagtttccattccattctcctatccctggcttgctggttcaatactcttaagtgatttactgctggtgctcttctttttccctcagagataccttgtgatttctttgattctctccatctctacaggttaataagtctaatatttaaaaactctgtagagggatgttgggaagctgtggggagagcccttgggcttttcgcctgggtaaagtgcagattcctgagaattctgggccttggcttccagctgcactagtgccggccactcagctgttctcagcagcgtcacctggcgcaatggtgctgaagcgcactgccgagaggccagaaggcaaagcgagagtcggtggctatggcctggaacccatttaggcaaaacagagggcgcgcggggacaaagcaatagagaagggtgggcaatacaggatctgtacaccatacattagcaattgtatttattaaattgttgattacctaagcctccggagagtagtttggacgcttaccggttttctgaggattatttggggaaggggtatgcatgcaaatgtatgtacataattcgtgtgatttcggaatattgactccatgagttccagatgcagatttggaacgtttttaaaaaacattttgtttttgttgtctcgcaaatcagccagatctgcaactgtatcagagtaaagcgaagccaagctggacccttaggaaatgcgctaacatgtcatccactttcggtgtctgcctgtgaaaattcaggcgataaagagaatgaagagaaccttaaggaattgctggaaccaaagttaatattaagcaggcctgctgtgacgtcctcttcctggcagaccagtggaaattgtagcctggtcgacaatctgtatagattgatgaggtctaaaatgtagtcacaggttcaactacttttctgttttccaacctcgagtaaactcactaaatttaagggctaacaaaaaaaaaaaaacaaaacaaaacaaaaaaaacctctgtttccgcccagtttcgaaccggggacctttcgcgtgtgaggcgaacgtgataaccactacactacggaaaccacacgcggaacctgcgcggcaaaacataaccatgaaaatcttagatcagccgtttctattatagtttccaaatctaagatcgcaccactgcactccagcctagacaacagagcgagagtctcaaaaaaaagttaggagaagaaggtgccattttccctagttgcttttcttactgcggtggtgaccgcattgccttcacacctgaagtccaagtgtttgcaccctggggaatatgcagacagctgggtcactggacgccaggccgcagcgccggcctcgttctgcttttggctctaaatgcagtcgggggacgcgactggatctcaccagagactggtgggctgttacccttaccagcgactggagggccaacctcccaaagaggcctacttcatgatcgccttaaatcaggaaatttcatgaaatcccacccctctaccgccccattcccatattgtatctcctcccctgcccactctgagaggattcgccccctttctgtctcgtctggaccctttggagtcccacatagacaagacaaaaggggcattgccttttcctacaggagcgggaagagccgtcacagcggaggaaacagagactcacagcgcgcatccccacatacttgcgccctgccgagttccagcaaacccaacaaagcactctgaagcttctctggaaaaggaaggagtgtgaggtttctgatacggcaagaggagccaaagagaggggacccaggccttcccctagctcgagagaacaaacccagaagaagggcagatccgaaggaaaagcgcaaaggcggcccaaccccacgacctgagcgagccaagggtcgcgggttaaattgcgtttatcagaacaattgtttgctcactgtcccaaagccctcctagggacaaagaaaacactggcatggcaccagtcgcagaagggggcagcattgacacccaggaacaggcgtggaaaagcaggaaaagcagggatcatctctctcctaccccgtatatggctgcagacatagcagtggttcttttctccaggacccagtgagtgtgcaccaggagagaacattatgcacgttattcatggtggcaccacccaggctgaaagtgagcctgtgctgcttgggctttcaggaaggacgggcccaactctccctccctatacagagctgcagtgccctggcaatggaggacagaccatggagttgcctgccctggactcggggaagaggctttgccctaaaccccattttagtggtagctgtcagagtgccatatccacagacttcagctgcaccacagccaggaaccaaaggacaaagtctttataaaatgaaggttgtgagctctgtgacagggcatgatagggaagcggatcacattcttgcctactcaggaggaggagctagtgcacctctgccccttcccctgagacctcagcacaccccgacatgatctctttcccaccatcctgtcagggcaggtttttccactggacaccagcctacgtaacagccctgactcttaagcaccatctactggactgcatcctaaactggaccactgaattcaaaaaccctgctaccaaagggcttagtgctagtccatgagataagtttcctgagaattccgtaccctcagcccccaacaagggttagtgtgttagcttttacttccaatacatcaccacaacaagcagcatctgagaaagctactgctcagaagctatccacaaccaagaaacccatacaaagctagggctccctgaaagcacccagaaatgaagccaaacaatcatacacaacatacaccacagtcataccatcaagggaaaaaaagaataaaaacattaaaaatcctcatccaaacaataccaaattcaaaactaagaagcaacagcttcctcggatgagaaagaatcagtgcaataactccagtgtacccagagtatttacacacttccaaaggatcacactagtttctagcaatggatcctagccagactgaaatgtcggaaatgacagataagaattccaaatacggattgcaagggaactcaatgagatccaagaaaaagttgaagtccaatgcaaagaaatcagaaaaacaatacagaatatgaaagacaagaaaactatattaagaaaaatacaaatagaacttctataattgaaaaattcactaaaggaatttcaaaatacattgaaagctttaataatagactagacaagcagaagaatgaatttcagagcttgaaggttggtctttcaaattcacctagtcagacaaaagtaaagaaaaatgaatttttaaaaatgaacaaagcttttgagaattatggggttatgtaaagcgatcaaacctatgacttattggcattcctgagagagaagaagaaaagtaagcaacctggaaaacatatttgaaggaataattcaggaaagaattttcctaacctttcaagagagattgatattcagatacaagaaattcggacaacttctgcaagatactatacaagataaccagtgaaaagcatacagtcatcagacttcccaagataaatgtgaaagaaaaaatcttaaaggcagctgaagaaaagggccagattatctataaaggaaatcccatcagactaacagcaaacttttcaaaggaaatcttacaagtcagaagaaactggggcctatttttagccacctaaaagaaaaaaaaaactgcctgtcaaagtttcatactctgccaatttaagcttcataaatgaaggagaaatagtttttcccagacagagaaatgctaagggaattcattaacaccagatagtctctataataaatgttcaaaggagttctaaatatggatggtacttgctaccataaaagcacatgtaattacaaagctcgtacaccttataaagcaatatataattgggtctacaaagcaactagcttaacactatgacagaaataacacctcacacatgaatattaaccttgaatgtaaatggcctgaaagttccacttaacgggcatagagtagtccaggtgtggtggctcacacttgtaatccctgcagtttgggaggccaaggtgggtggatcacttgaggtcaggagttcgaaaccagcctggccaacatggtgaaacttcatctccactaaaatacaaaaattagctgggcgtggtggtgggcgcctgtaatgccagctactcgggaagctgaggcaggagaatcacttgaacccaggaagcagaggctgcagtgagccaagatcgcaccactgaactcagcctgggactccatcaaaaaaaaaaaaaaaaggcatagggtggcaaattgggaaaaaaaaaaatcaaactttccatggcctttaagagagacctatcttacatgttatagcccccaggggctcaaagtaaagtgatagagatctgttatgcaaatggaaaacaagaaaggtcaggagttgctattcttgtatcaagtaaaacagactaaaccaacaagagttaaaaaaagaaaaaagacaaagaagggcattacataatcagaaagcattcaattcaacaagaagatttaactatcctaaatatatatgcacctaacattgaagcacccaaatttataaaacaaatacaactacacctaagcaaagaaatagacagccatgctatactagtggaggacttcaacatcccactgacagcactagacagatcactgaggcagaaacctaacaaggaaactttggacttcaattggactcttgaccaaatgaacctaatagatgtctatagaatactctatccaacaaccacagaatatacattgttctcatctgtgcacagaacattctctaagattgaccacatactcagtcataaagcaagtctcaataaattttttaaaaaatgaaattatatcaagtatcttctcagacaacagtagaataaaagcagaaatcaatgccaagaggaactctcaaaaccacacaaatacatggaaactaaacaacagaatcatttttgggtaaacaataaaattaaggcagaaataaaaaaaaattgaaacaaatgaaagtagagacacaatgtgccaaaaactctggaatatagaaaagcagtgttaagaggaaagtttatagcactcaatacctaccttgaaaagatagaaagatctcaaattaacaacataataccacacctaaagaactaggaaaagaagaagaaacaaaacccaaagctaggagaaggaaagaaataactaagatcagagcagaactaaatgaaacagagataaaaaaaaaaatacaaaggatcaatgaaatgaaaagttggttatttgaatgattgatagaccactagctagattaaccaggaaaaaaagatccaaataagcacaatcagaaattacaaaggtgacattacaactcatatcacagaaatacaaaagatcctcagagactactatgagcatctctacatgcacaaactagaaaaacctagaagaaatagttaaattcctggaagcacacagcttcttaagattgaaccaggaagaaattgaaatcctgaacagaccaataatgagttatgtaattgaatcagtaataaaaattctactaatctgaaagagccctggaccagagagaattttacagctgaattccaccagacgtgcaaagaagagctggtaccaatcttactaaaactattccaaaaaattggggatgagggattcctaactcattctatgaaaccagtatcatcctgataccaaaatctggcagggacacaataaaaaaagaaaactacaggccaatatccctgatgaacacagatgcaaaaactctcaacaaaatactagcaaactgaatccagcagcacatcaaaaagataattcatcatgatcatgtgggctttattcctaggatgcaaggatggttcaacagacgcaaaaaaaaaaatgctattcactgcataaacagaattaaaaacaaaaaccatactattatcccaatagatgcagaaaaagcattcaataaaatgttacatccgttgcatgatacacaccttcaacaaaccaggcatcaaaggaacataactcaaaataataagagccatctatgacaaacccatagccaatatcatactgaataggcaaaagttggaagcattccccctaataactggaacaagacaaggatgtccactctcaccactcctattcaacacagtactggaaatcctggccagagtaatcagtcaggagaaataaaagcaatccaaataggaaaaagggaagtcaaattatctctgttcaccaaagacatgatcctccatctagaaacctctaaagattcctccaaaatactcctagacttgaaaaacaagttcagtaaagtttcgggttacaacatgagcatacaaaaatcagtcgcatttctatacactaaaaatgctcaagctgacagccaagtcaagaacttaatcccatttaaaatagccacacacacacacacacacacacacacacacacacaaataaacaaaacacctaggaatatatttaaccaaggaggtgaaagatctctactgggagaactacaaaacactgatgaaagaaataatagacaacacaaacaaatgggaaaacattccatgcttgtggactggaagaatcaatattgttaaaatgaccattctatccaaagcaatctaaagattcaacgcaattcctatcaagttaccaatgtcattttttacagaatttaaaaaaaaaattataaaattcttatggggctggacattgtggctcatacctgtaatcccagcactttgggaggctgaggcaggaggatcacttgaggtcaggagttcaagggcagcctggccaatacggtgaaaccccatctctaccaaaacacacaaaagttagcaggcgtggtagcacacacctatagtcccagctaattcaagaggctgaggtgggagaatcacttgaacccagaggcagaggttgaagtgagccgagatcatgccactacactctagcctgggtgacagagtgagaccctgtctcaaaaaaaaaaaaaaaaaaatccccatggaaccaaaaaacggcccaaatagtcaagcaatccaaagcaaaaagaacaaatccagaggcatcacattacctaacttcaaactatactacaaggctatagcaacaaaaacagcaaggtaccgacacaaaaatagacacatgaatcaatggataagaatagagaacccagaaataaagtcacacacctacaaccaactgatctttaacaaagttgacaaaaataaacaatgaggaaaatgataccctatttaataaatggtgctgggaaaactggctagccaaatgcagaagaatgaaactggacccctacctcccaccatatacaaaaattaattcagatggtttacagacttaaatataggacgtcaaactataaaaatgctagaagaaaacctaggaaaacctcttcttgacattggcctatgactaagacctcaaaagcaaatgcaacaaaaacgaaaattgacaaatgggacttaaacttaaaaagcttctgcacagcaaaagaaataatcaacagagtaaacagacaacctacagaatgggagaaaatatttgaaaactatgcacctgacaaaggactaatatccagactctataaggaacttaaatcaacaagacaaaaccaaataaccctatttaaaaaatgggcaaaggacatggctagacacttatcaaaagaacacatacaagcggccaacaaacatatgaaaaaatgcacatcactaatcatcagagaaatgcaaattaaaactacagtgagatatcatctcacagtagtcagaatggctatattccaggctcgaggcaagcgtgctcttcacgagttctgtcattctcttgagtgaagctcacctggtatggtaagttgtcctcattttaaaacattcagattttattctgcaatcctttcacatgtgacagtttttctgttcttcctaagcatgtaatggaagtcaaggaattctacatcctcactatctattaatatttcttaccttcccacagcagtgaaattcccattctagtcttctgaaacagagatagctaataaagaaaactcatttctcctttaagcttttccacacatttcagaccattctggttttattcttttctacacaaattttactctttataggtgttcaataaataaatataaacactaattttaaaaataatttattaatttgatctcttcatttaaagataatatccaatgcctccaagttcccacccaagaattctgttggatagggctggaaaagttctggagaacattcttccagactctctaggcatcatgtcacaggatgtcctcaccacagccagaagagtgactctgagtatatgaatgaggggctacagtggactgtgcagtacctagggagggagagacagggctgcaatgaagtctggagggatttaggagattcattgattgtaccaaacaaaaacttaatttcttctctcctattccgtacccaggtgaaagtgggaaagacaggaagagagacaccaagctttctagttgacagctagtgactctctgattatctgcaaagattgggaaaggaacttaaacatgacatgtagattttccagagatatttactcctggagccaggagtctgcgaacatgtaggtgggatcttttaagaagcagccttatctagattgggaataagctattatagttttaggctgtgtggatctggtcaacttttgtgctgcctacttctctttgcttctacaactgggcatcgctgcagaaaggaagaaatatggaagtgacttcagctttgattttttccttctggaagcctgaaaactccagtttgcttccctgagcccttttcctgttgcacaactagggtgtggactacaggtcctacccatggaagatggaggtagatacttcacagggaataaaaacaacccagacaagtcatacctttaggtaacagatactttcaaagatgtactttcctgcacccattaaagttttagtctcagctaatctgaaaacctgcggtcctcctgcactgggatagcagtgcaatatggctcaggctcaggttttgctgggcacaccagagtaggccacacactctcatgtgaagtggcttcaggtatggatcagggtctttcccactaattggcttcagttatgatgttgtaggtcatcattcttctggctttaatacgagagaagaagggatggggaagaactggtctccaagtgagagcatccagggtgaagagtgtggaaataagggtcattagcacaagagaagagccaggtgatatcaaaggcatgtagtaatggcataaaggtggaacgttgctctcattctgctgaagtgggcaccatggaaaccttggtgctaccactcgccagtcaggccacaagcccaagaacagcaccaggcagtataaggacatataagaatgacatcacttcagatagtcctgagaattagacctatccctgcttggggcaaaccactcagtgggagcaatagtacccttctgcttccctatctgggctaattgtaaggaacaagtgaaatcatgcacaccaatgtgctttaaaccggtaaaactctgccccaagaagctatgtgcccttttgagactccctagacgtggacagaaacataaaatttctgcctttctaccttttccttggtcaccattgctaagcacatgctgcagcctctccctcaggcggtcattgagactgatggactcctccaggcgctggcgcaggttctgtatctcagcaagattcttttccagcaggtcggcccctactgcaaacaccaagacataggagaggtaggaggtagggaagcctgatcatccctgggcagctgtggggcctgcgtggcatctctctgcaagatccctacctatctctatccttctgtcagcttcttcctctctcctgggcattcaggaagcaccaggcaactttacttaaaagtcctgggctttcaatcacagggtggccccctgtaaggaaacaccacaggcctcctcccagacagagaccaccaagtacatctaagggagatggacacagggtgagaaactgctaaaggcctctaggcagaactggcctagtaatgggaaaggctgtctacctccttggtatggaaaacaatccagagaatctccctctctacctcatccctctccccgatgatgatcccgactcaacagcctttgagatttcactcactcacagacagaaagaccaaggtaagtgcatatgaaattaaaccaggctgtgaataatgagtgatagtgaatgttctcctttaaccagttttggcaaagaggaacatggaagagcttgggaaggtatcaggatctgaagtgggggaacaggagagaagggaacaatctccaaggaaggaaaaagatgcacagagagaggaggctgagaataggcttcacccactgggagattttgcgtagggtcaggcttttctctgagaatttaaaatgtcttattgttacactacctgggacacagaaatggagctgcttcaagccattcctctaaatagctgcactcctagctgccgggtgccaggatgtttggttccaaatccaaaagcaatatttatgggggcaggattggcacgtggttgtatgcacagtgtgtgtgaaagatgtgtgtgaaagagtggaaagagtgtgtagggctgggtgactctgtagaaatagtttcccatccgacagtagctcctgacctaaggaagaccttccccatggaaatctgagcttagcattccaggacagtcttaatctaggcctaagaaggttgtagcacagagagaaggcaacatttaagtgtgaggtaacttatcctccttgtagagcacctcagaatgtccctgacttctcctactctcctgcccagagtgagttcctaggtagggtggctaggagaaggcactttcaaagaacaagcactgagctggttctcactgtctggctgatctacatattgtcctgtcattttttatgaaccaggttctaacagaggaaccaaaaaatcctctggccaggaaaggaatgtgtcattcctaccaatgggctcgatttcactaagtgctcctttgtgttttaccagaggtttcggagttgggttggtacaaagaggagaaggaggctaggtctccagatgcattcattttttgaggcctcatctcttcccatgggccactgctaccgtgttctagtgtcctgctctgctgggccagtgccgctcgaaggatggaagggctgggcagacctggttccttggttgctgggcaaagcagctgaatcagcagaaatggcagggctggcatctgtccagaaaggaatgtgagtgagaaaccaacagggaagtcataaaagagtattttaaaggtaattatagtgagttgaatagtgtcctccaaaaattcattcagttcacttggaacttcagaatgtgatcttatttgtaaatggggtttttgtagatataataagttaagatgagatgatactgaattgggggtatgtcttaaatccaacatgactgatgtccttatgagaggagaggagacacagagataaagagacacacagagaaggagaccatgtaacaagagaggcagagattggggtgatgtgtctacaacccagaaaccaccagaaactaggaagaggcaaggaaggatccttccctggagtcttcagagggagcatggccctgctgactccctgattttagacgtcttcatctccagaactgtgagagaatacatttctgttttaagacgcccggtttgtgtttttttgttttggaagcccttgaaagctaataaagcaatccacggaatgaagactaaggcagatgtcagcagactcatttcccaaggacttcccatttcaccctaaagtaactggcatttctcagcctatgacataagcagtagtgttagttgtaatatctgagcatcacagcgcacatacaggaaaaatatggggcccctctcctagctccctttatgattcccaatgctggaatgatcctggggaggtacttcagaaatgtttctcctaatagcaggactcacagccaatcctaggagttcagacagtgaggggtgaagcattttgttggtctgtaaacaggtgactatttattcaacattctatgcccttgctagaaacacaccagctactccttcctgggattgttctacactgaggctgttggaggaggaggagaaaatggcctccacttctggacaatgtgcagagaacctagagagtgttgcttccactcctggtggttctctctctggcctcggctgactctggacctgcagtgaagctgagggggtgtctgtctaaggcaagtggtgatttggattccacctagaatggcttttgacactgcaaaaataattcttatgtacagctcacattgtctggctcctgtccatagaatagctagtgtactcttgcatagaggattgtagaatcacaaaatacatggcatcttacagctcaatgatgccatgagaacatggccagatcctctgggcccttcattactgtctccctttgagagaaaaaccaagctggggtggcagggccataattcagagaaaagttttagagtctttccctttcgaggattattatcaagggctaaagaatagacaagtttctcctctgagcaggtgggagtgaggtttctgtttgccctcaacaacatcacgttcttttaggaactgtatatttaaatcagtatccagtaggtctctccttctccaatttataaaatatcagatactaattagaatcactgtgagataaagagtaacgacaactatgttaagtctttaataaatgcctgacttaaagtaggaactcaatcaaaatgtgattaccaccccctttcaaacctcctttatctcagaaaatcagtttactctcaaccatggccataggaagctctaagttttatcagtaacagtgatcagtgttttaacgttccctggccataccacaaggggaacatgccctacactgcagatggaaagcaacagagactagacttttgtgaaggaaatttggcctcacaatgtagctgtcatgccagtgcactacaggttgactgttctagaaattttggttcaaaaaccaaagaggaagtggtgataaacagttgcccctgtgaaaggacagtgacttcaagtgggaaagagaagggcttcgatctccctcaggaaagacagttgtggcaaaaagtaaagctggtgctctccagaagcatcattccagaggccacacctcactgcaggcagtggcagggattgcaggtaagggaagcatgggcttgcccttctgccatctcttggggcagtgctgaggttgaaacaagtgcctctgggcaactgaatcaaggatgcacataaaagtcccattggccccttggaataggtgatgtacatatcaagggcagctcatctatttacaaattcttagatagaagtgtaatatgtgtaaggtcttgtcccatcttcagaggccagaactctgctgggtgcacagagcagaaaaagtggaatgagaaaaaccctggctccagaagcctagcaaaagaggtgctgagaaggagtgagcaccctttgtgtgcagcccctgacttctcaggctgcagagtgaaatgctcacaacctgagctttgagtcaggtagactcaaagtgtatgttaccccaagctgctttgtcttcagtaagttccttaactttgctgagcctcagtgtcctccactataaaagcagaacaccactacctatttgaggggatcactgtgtcaattaaatgaggaaatatatgtatagtggtcaatattgtgagcataataggtgctcaatcaatgagaagttcctgtctttccttggctgctataatcttagaggaaacattttgccgctttgctcctcattgtgaaatgagaaacaggaatagtaccagatcaaaacccattatgggccgggcatggtggctcatgcctgtaagcccagcactttgggaggctgaggcagttggatcacctgaggtcaggagtttgagaccagcctggccaacacggtcaaaccccatctctactaaaaatataaaaattagcctggcgtggtggcaagcacctgtaatcccagctacttgggaggctgaggtaggagaatcacttgaacccgggaggcagaggttgcagtaagctgagattgtgccactgcactctagtctgggcgacaacagcaaaactccgtctcaaaaacaacaacaacaactaaaaaccattatggctcactcattacttaaaattgccaatttagaaaaaaacaccagatacagccagggactaaaaataatttcttggtattgtccacattaggatatgattcatactggcctaaaacttcaaacacttttctcaagaggaaaattaaagagaaaactgagcaggagaaaaatgaaagtctggtttaaaacttaatctcttcccgtctctatcaaggctatcccaaggaccctctcagggaaattctcaggagggacacgctggttggtgatggactcagcttgaacctcacagcatggccccattcactgatagtttagagggtgttacagcaaacttattaggatgatggatgggatctgtaaatgcataaatgataaagatgatttagtgatgaacaaaaaataggaactgtggctgtttaccccagggattccaggattaggtgcacaatgttagcaacactcatgtccctagtttgaaagatgacataattgtgtgcagtgaagaggaactatttgccccctttctccccttcccaacccatgccccccaagaccaacaccatgtatgtgccagaggggatctagtgactgatgacatgtgagactgggaatggagaaaagctacctgaaaaccttggggcttatgctcagcactgagtcctggagctgtgcccgaccagctacatcacagtggatctacagggcccggctgcaaagatgccacctcttggcctagacaatgcatgagccccaaaaactggagccatgtggctactcactgactacagtcactgaaggatgcacttcctccttgtcaagctgtggagacgtgctgctcagggagtgatgtgggctagaccgggtgtggttgctgcaccagatctggggctgagtctgggaccgggcatcccacttggtctctaggacttctgtcactttactcatattatgcatcttcctcaagatactagtggggtaagaaagaagaaaaaataaaggtcacctaatgccacagctgtactaatctggaggctcacaggagatgtaaaggggaggtcaagaggatcattccttcagaggagaagccaaacaaatcatttctgtttcaggatagagtatggagggaaggcggggacagagagagcaacagttgtctggtgcattggctacaaacatcctgaggaaaaacgaagccataatgggccccttaaataacactcatgattccttcacaaaacagccagagacccataagagttcaactccaggtatgggtatggcggtacatgcctgtaatcccagcaatttgggaggccaaggcaggagaattgcttgagtccaggaattcaagaccaaactgagaaacatagtgagaccctctgtctacaaaaaataaaaataaaaaatgagctgggtgtggtggtgtgcacctgtagtcccaactatttaggaggctgaggaggatcacttgagcccaggaggtcaaggatgcagtgagcagtgatcgtgccactgcattccagcctgggcaacagagcaagacctcatctcaaaaataaaattttaaaaatgttaaaaaaaaaagaattcaactcattctgtgaacataatttttaaaatagtatttgctataggccatttaaaacagattccccaggcaatgtagcctcactggtgtcttgcagtttctagatctccttccctaagtatagagacacagtataaacttttgtttgcaaggaaaatttgtagctgttttacatcttccagcactccttgggtcacccttgaagaaatcagatataatcttactctggtctttaaataagggaaaccagaggtgatccctggaggttcagaagactcctaagacccagataggttagagcagctctatgttactaaattggtgaattaattggtgaaaataaaagaataatatattttttaaaaaattttaaaaatgagactgccttatccctaaggatacataatggtttaatggataaataagctatttgttttttactggccatgtatgctcctgtttctttgagcttctggctcttgcttctggatccttcaccagattacatcttcgacagcccctgaaaatttggagttacctgagagtcgaagacacctgtcctacttgattcttcttacttgtacagtcatctgagaacaaaattcaaaaaggccagtcatgctttaagcaggtctcatttcccagactgcaaacaaacatggaggtctatctgggagcagagacttgactacctgatgcttgccttgattccaggatactctgaattttctcagatcttgggttgagtctttagagagcttgcctggcaggctttcctgagcccaccatgaaggtcatcatctccacttgctttgccctgagtcacagcaaaaagctaaaaatgtctttattcccacatatcatggaacacatatccactccagccaaagcctccaagtcctggcacaaggccagcacccaaacccatggctgtgtgttccaccatagctttcatgcagaacttcctcccttctccaaggagatgatagacatccgtgtcccacctaccatcaggagacagcacagtgaactcaagccttctgctactatgggcccttgggttctcaagggggaatttcatgtaaaatgctcctgaaacagctaattatctcaccaccgtgtactagtacacacagtgcctgaaccatgccaaagtcagcatgattctttatcatttttttgaagtgcgccgattaatgttacttatttaatccctagaacaatcatgcaacattcaagggctggaattatttgacttaattttttaggtagagaaacagaaatcaaaataaatattaacctgtccagagctggtaaggaacacatataagctagaggtagggtttttggattcccagttcagggcccttcacaaaaaccagctgcccctgctccttctgtctttctgccaattagtttcagatgaataccatcatccctggggatgcctcctgccctaacagtcatattccatgagggatggaggtgctggtgatcatcatggcatcctcaacccttcttcttggagctcctctccagccagtcctgactctgtcatggtcataaggtggtgattacaaagcaggacaccaggttgaaaagtgacatgtgaatgggggtgggatcctgtgaacttaggaccttgggagagactgaaaatcttcctaagctctgcggccaacttacctgtgctgaattttctggcaaggctctctgccagctggcttcctttggccagctgcttgcagtagtgctgctccatatagtggtcaatgttattgctctggagtagctcctcaaaggtctttagtgtgttcttgacatgctggatgagaagaacagaggccactctcccaagcttcatcttctgccgtaggtgggttaactcttgagcctgatcctgaatcaaggaatgatacttcctaaagtagaaaaaaagaagtaaaggtagataggaataactgataggttatagcaatttaggagaaggaacttgagagtatcaccaaaggaggccacacactgaattctagcatatgtttagtgtcctgaatatggtaaaaggaatgaaggaaatgaaaacaatctttatgtgaaagatcccttctaagattgtcattttccctgccacttgctaaagaagaaaaatcacttgatcatattaatagatgaagaaaaagcatttgacaaaattcaacactcattcatcataaaaactctcaacaaagtgggaatagaggagaccttcctcaacttgataaagaacatctataaaaactctacactaatgtcatactagaaactagaagctttctcactaacatcaacaataaggcaagaatttccccgcttaccacttcttttcaccatcatactggaaatcctagctaatgcagtaagataagcaaaggaaataaacggtatacagattagaaaagatgaactaaaactgtctttgttcacacatgatgcagttattgtattatagaaaatctccaacatggtgaaaccctgtctttacaaaaaatacaaaaattagccgggcgtggtggcatgcgcttgtaatccagctacttgggaggctgaggaaggagaattgcttgaatccgggaagcaaaggttgcagtgagatgacatcgtgccactctgcactccaccctgagtgacaaagtgagacactgactcaaaaaaaaaaaaaaaaaaaaaaaaaaggccgggcgcggtggctcatgcccgtaactccagcacttagggaggtcgaggtgggcggatcatgaggtcaggagatcgagaccatcctggctaacacagcgaaaccccgtctctactaaaaaaacaaaatagtagccaggctactcaggaggctgaggcaggagaatggcttgaacccaggaggcggagcttgcagtgagccgagattgagccactacactccaacctgggcgacacagtgagactccatctcaaaaacaaaaagaaaagaaaagaaaatctgaaagaattgacaacaaaaatctcctggaactagtaagtgattatgtcaaggtaaaatctaacaaaacatgtacaagatctgtatgaggaaaactgcaaaactctgttgagagagatcaaagaagcactaaatacacagagagatattctgtgttcatggacaggaagactaaatattgtcaagatgtcagttcttcccaacttgatctaaagattcaatgcaataccaatcaaaatctcagcaaataaattttgtgaatatcaactaacagatgctaaggtgtacatagagaggcaaaagacccagaatggccaacacaatattgaaaaggaacagagggctgatatgacctgacttcaagacttactgtaaagctacagtaatcaggacagtataagatttgtgaaagaatagacaaataagtcagcggaacagaatagagattccagaagactccaaaatatagcagattgatctttgacaaggggacaagggcaatacaatggagaaaagatagtattttcaaaaaatggtgctggaacagcgggacatccacatgcaaaaaaagtgaatctagacacagacttcacattcttcatgaaaacttactcaaaatggatcataggcctaaatgtaaaacataaaatgataaaaaaaaaaaaaccctaaaagataacaacagctgaaaatctagatgaccttgggtttggtgatgactttttatttattttatttattgatctaaagattcaatgcaataccaattttaatttagagacagagtctctaaataaattaattattttatttatttgttggagggcatgatcatggctcactgaagcattccttgggcgtgatcatggtgtgattatggctcactgcagccaaactcttgggctcaagtgatcctcttgcctcagccttccaaagtgctgggattacaggtgtgagccaccgagcccagctatatgattacttttcagatataacacaaaaggcatgatccacaaaagaaataattgataatctggacttcattaaaattaaaaacttctgctctgcaaaaggcacatcaagagaatgagaagacaacacactgggagaaaatatttgcaaaagacatatctggtaaaggactattaagccaaatacacaaagaactcttaaactcaacaataagaaaatgaaccacacaataaaaaatgggcaaaaaaccctgaacagacacctcaccaaagatgatggcaaataagaatatgaaaagatgctcaacatcatatgtcattagggaattgcaaattaaaacaacaagataccactctacacctattagaatggcaaaatccagaacactgataacaccaaatgctggtaaggatgtggaacaacagatattctcattccttgccggtgggaatgcaaaatagtacagccactttggaagacagtttggcattttcttgtgaaactaaacatactcttaccaaatgacctaaccatctgctcctcagtattttcccaagcgagctgaaaacttaagttcacacaaaaacctgcacatgatgtttatagcagctctattcataactgcaaaaacttggaagcaaccaagatgtccttcagtaggtgaatggataaattttggtacatgcagtcaatggaatattatttggtactaaaaagaaatgagttatgaagccatgaaaagacatgaaagaaccttaagtgtgtaagtgaaagaagccaacctaaaaaagctacatactgtatgactctgactatatgacactatggaataggtaaaacagtggagacagtaaaaagatcagtggttgccaggtgttaggagggaaaggagaatgaataggcagagcacagagaatttttagggcagggaatagtcattctttattacaatggtggatacatgccattatacatttatacttgtgtcaaaacctatagaatatacaccaccaagaatgaaccccactgtaaactgtggactttgggtgatgatgagtcaatgtaggttcatcagttgtaccaaatgttatcactcgggggcaagatgttgatagtgagggaggctgtgtccgtgcaggggtagggggcatatgggaactctctgttactttccactcaattttgctgtgaacttaaagctgctcttaaaaagtccattaaaaaaaagaatgatcacagaagtataatttttaaaaatatatttgatgaagtgggtgtagtgtagcctttgtgaatcgagagcacaggattccaatgttatctctgccagaggctattatgcaactttgatcaaatgactatctcttagggcctaagtgttctcagttctaaaatgaggtaatgagactaactgactctagagttttttgggtgttttgttttgttttgttttgttttgttttgttttgttttgtctgagatggaatcttgctctgtcatccaggctgaagtgcagtggcgctatcttggctcactgcaatctccacctcccgggttcaagcaattctcctgcctcagcctcccaagtagctgggattacaggtgcccaccaccatgcccagctaatttttgtatttttagtagagacggggtttcaccatgttggccaggctgtctccaattcctgacctcaagtgatctgcccacctcagcctcccaaagtgctgagattacaggcgtgagccactgcgcctggcctagcgttattttagccctaactaacattattctctgggtcagtgaaatttaagtggaatatattgggcagtgacctaatggagcatgaagcaggatttgaatcacttccaaagctgtgcaccaaccacttaggcaaattagtgatttcagtaacttagtatttcagtaactggcgctcacaggcaaatgcgtaatggattaaccccatattatttaaatgcttccaaaaagctataggaaaatggccatgaaaaacaaactgacaaatttagccaacaggccactatttgacaattctgcaagcttatttttaaaattcagcttatcaaaactgccattccagaagccagggacctgagtttccatagaggatggagtagaatggaggggcctctgtataaatctacctcctcgggaactgggacagttcagcattcaccagagtaacatatgaagaaacaggagattcctacatgctcctggggatccagaagagagaccactcacatgactggaagatttccagctcaggtaaccacaaaggccatatatttggtgaatacatgcaatgttagttagaataaaaccaaatttctctgaataatataaagtcattactaataaaacttttatagatttttctctgaagaaatttccaggaaggtgttaagagaaaaccctacaattaaggtatggaggctggctgcaggccctgaaagctactctgacgagcaatgacttaatgctgatagtgggaagtctcttgcccactgcaggatacagagaattcttcctcaacccgaggcttctgctcattcactcccttctcagcaggtcccttcttctctgagggctgatgcatcccagccttctgctgggacattttctcatgaagagctctcttacagccgtctttgaaaggaaggacagagaagaaagatgtctatgtcttcacaatggccaggcttttctccaaaactacctaaagcaattgaaacaaaattatggcttacagaggttagattattagtggagatcctgtaggacgatagaatctcaagagcagagcctaccaggaagtagagtgaagcctacaacttcctcagccatgaggacccaacaatccactgggtaaaagaaagatgcagcaagtgctggggtggggtcggggtgggtgctgttatgagaaggaaggggaggtcccacaggtgtttagaagaaaaaacaggcaataaatgaatgaaaacaaatggggtttaaactaagctaagggatgagtatttttgtttcttatagctgagataaggttcttatgaagttcccagggaatgtcccttcagaggtcaggaagcattttgcttccacaagttttgagagtcatgaaggcaggaacacattttcagatgccagagctcaaatcccatgtcactgggacatcaacaatagtgctatggggaagactcagggtgccagctcttgagtcacaatcacagaattagaatgtggaagtagctacagaacccaaggaagccctgccttctgatagccacactcaatgcaaggctgcgtatttcaccctggaggtctctataacaggggaggccaccccctcaatagccagcttttttacccttttgcttatgttgtcaaccaatttctaaccacagcaaaataacctaagtatacctctccttgaaaacatcaaaacactttctcagcagcttttactttcttgaagacaatttcagtaaaaacaattcttgtggcttttcctaaatgattttttttttaacttctagtgattcttactcttcgtttttaggaactctccaggttttcacttcctacattctttcaagagtatagtgactaaaactggagaataatcatttaagtctgactaataaatttagcctcatgttgtattaccttttaatacataataaataatatatcccaatgcgatacttgcttcctttcccttgcagtagcaacgtgtaggggtttcatttaatatgaggtcgattttaaccttccaaactcccattccacccacctttgcttgcactcatgggaaggctcagtctatatctggtttgcccacattcctaggctatagacctctaggactcccaatttgagaggcgccatttttttggagggtagtgaattttgatttctgtctcctttgcatccttcccaatgaaaactgctttcagccactctctgctagcctctcaccagcacagagctgaattcacaaatgccttgaggggaaaacctttaccaagtgttcagttcacatctcaattcattctagaatcttggcttttcaagtcaaaatacctggacagctccacatgtctacccactccccacccccatgaggttacttaaagtgctgctgttttctctggtttttaaccactgccctctccccagcttctcagcctcttgtcccttgccaagaactagcaaataccctgagggggaaaaattgtttcattccaatgatcttctttctctctctctctctccacccgctttctgtagctggccctgtgggtcctagcttttcaaagacttcaaacagaattcctttaaaccagattttatctacttcttttcgaagggagtgctggtttgccacaaaactccatcgtaactgaaagaggaaatcttctacaaattccaggtaaatcaaattttcctaccttgatttctgaagaaaacaaaaaaaaagagaagaggccattggtaggtatatacttgcatttttcttgtaatacttgcgtaagtctgaatgggtattaaaggctcttgctagaatcatgtgccaaagattgtctaccatgacctaaacaatcaggcctgtccaaggtccaagaatttgatcaggttggatccagtcctctggtgcactaacagagatcctgttggaggatagaatcctgctgtaggattctacgtctgtactttgagtagacacttcaagtaaccagtttttcagacacctggccactaatatggggagaagaggtcaaaaaaaccattgaatatttctaatttattttagggaatgttaaaatttctcactggtacagttagaaatgaaaacaaagacataataataatagtaataataataataactgtttcaagagcattattatgtgactggcattgtttctaagtgctttactgtgtagtaacctatttagtccacataacgaccctacaagatagtgttgatttttttgtttggtggttgttgttgttgttgttgttgttgttgttgtttgagatggagtctctctctgtcatccaggctggagtgcagtggtgtgatctcagctcactgcaacctctgcctcccgggttcaagcgattctcctgcctcagcctcctgaacagctggatcacaggccccacaaccatgcccagctaattattgcatttttagtagaggcagggtggtttcaccatgtcagtcaggctggtctcaaactcccgatctcaggtgatccacctaccttggcctcccaaagtgctggaattccaggctgagccaccccgcgcagccgatagtgttgattattacaaccccttgttgcagatgagaacattgcactgaaaggctgagcttacctttccaaggtcccatcatctctatgagagtgagagccaggactcatccagacccttgctctgagccattaggcttggtggtaactaagaagatctcactaagatgcgcattccctccttcttgctcaatctccaagatttcgaggacaaaatggaaattaaaagtaaggcctacaagatggctattattttaaaaagaaggaaagaaaattatcagtgttggtgatgatgtggaaaaattgaaacccctgtgcactgttgtttggaatgtattaggttggtgcaaaagtaactgcggtttttgtcattacttttaatggcaaaaatcgcaattacttttgcaccaacctaataaaatggtacagccactgtggaaacccatatggtggttcctcaaaatattaaaaataattatcacatgatccaacaaatttacttctggctatatactcaaaagaactgaaagcaaggattcaaagagatatttgtgcacctacatcaatagcagtattacaatagctaaagaagggaaacaacccaagtgtccaacaacaggtaaatgaataaacaaaatgtggcaaatacatgcaatggaatattattcagccttaaaaaagaaaagaaattctgacacatgctacaacatagatgaacatgaggatattatgcaaaatgaaataaaccagtcacaaaaggaaaaaatactatataattctgcttatatgaagtatctagagtagtcaaattcatagagacaggaaataatggtggttgtgccaggggctagggagggaagaatgggaaattaatgggtatagcgtttaggaactttagtctaagaaagtagaatattggatgccagaaattcagttttctttctgttccaagatccctttagctagagcgacatattgaagtcagagttcctaagggaaaatcattgtgcatggagatcatccttgtggatcaaatgtgaatcaatagtagatcaaaagatattccacttttgcagatattgacatttgttggacccgtaagattttatctagtattagatagataagatgtgaaccacttctcaacactgcagactcaaatactaggaaatactaagaacctcaggacaaacaaatagccagtccaaaaagactcacagactagataagctgtcatctaccacctaacagataatgtatccctgttaaccactatccccagatgttcatttcataaaatcaaaaacagaattccatgtggatcatggaaaaaaatggttgacaatgtacaaatgagagagagaaaaaatacttgtctaagaattacatttagtgtctaaaagccaaatagctcaatttctgctcatgagattcaacagatgaactgagggaacatatgccaatagctctgagattacaggtccgcatgggatgcccataagatgcaggattctattagctaagattatatgtctcaggtgggcaaatctttgtggacatagcaagaaaaaagaaaaactgtcaaggaataatatagagacagtgtgatggttaattttatgtgttaacttggctagaccacagtgcccaggtatgtggtcaaatataattctggaggtttctgagaaagggtattttggatgagagtaacatttgcattagtagactttgagtagagcaggttgccccatgtcatgtgggtggacctcatccaatcagttgaaggcctgaatggaatgagattgaccttcctggaagaagaggaaattctaccaacagaatatcttaggactcaaataacaactcttccctgggtctccagcctgcctgccttgaactttcacaatcatgtgagctaattccttaaaataaatcaataaaaatagatgatagatggatgattctgtttctctggagaaccttgactaatacagatagcatactaattcacccttgccatttatagaggaaagagtggagtaataaatatcagaatatcttctccagacctggtcaccacagaaacaaattatagctatgcaaaatatcttggaagtttagctgaagagatgaggagatactctactgctccatgtgcgccatgtcatctgttgtacctccccttagttaagtcaggagggcaacactccctttattttttattttatttcgtatgtatgtgtgtgtgagatggagtctcgctctgtggcccaggctggagtacagtggcgtgatcttggctcactgcaaccctgcttcccaggttcaagtgattcttgtgcttcagcctcccgagtagctaagattacaggcacaggccaccacctgtggtaatttttgtgtttttagtagagatggggcttcgctattttggccaggctggtctcgaactcctgacctcaggtgatccgcccacctcggccttccaaagtgctgggattacaggtgtgagccacagctctcagcccctctatttatcagacagatgtatagaaagtttattgtgctagcaagagtatgaagaaaaggattctctgagttgaaaaaacaaattggaatataaattggtaccacttctatggaaggcaaatttacagagcttattaattaaaataaaaaatgtgtactgtaaccactatgatacagcagttgcgcttccagaactctaccctatagaaatccgtgtacaaatagcaaaagatatttgtacaagaatgatgactgcagcattatttgtaatcgtaaaatcatggaacaaacttaatttaaaaaacaacatgtaaagggttagatgatggaataaacaaaagaagaaatgccttcatcaaaaataatgcagaggataataataatcttgagtctactgataacattattgattgagcaattattaaatctaggcacatcctgcaaatgcggtattattaccatcctcatattacagttgaaaaaatattgaggtacaaatagcttgtcaatagcccaaaggcacaaagagaagcaagatttcacccagaacccgtgaacagatcacacaaaatttctcttgttccctggtccaaggaacttctgtaccttccaactgcatttctttccaacagagaccttcttggaggatgagaagcagccactagttgacaggaggggaagtgaggcatgtagtcttcaagggagcagaccaccgtgggagttataaaagatcagcgacgcctctgggtgtgttcgaaccaccaactttttagttaacagccaaacgcgctagccgattgcgccacagagacatggctgagctcctgatttcgttctaaaagagggtaagctgtcactaaacgctagctagcaccatccgccttttgcaaaatgactgggtaatctccaaagcctcggaaagccggagcagtcagagcgacgaatctacttgtttgtcaagcttgaaacctgtgcactgagtgattccgaaacgccccgcaccccgccttgccccctcacctgcctcagaagccggcgcttccggagatgccgggatcgcgactcctgttagagcgacttgggccccagggaagctgaaacgcccagggtgctcaattaggacttgttgaattaataatacatttcagagacagaatatacaatcgaacaatggccggactgtacgtaaaaatataactctgatccacaacctggggccacctgcccaagaaatcaacttccttatctacgaataaacaaccggggaagccagcctgctattacataagtcagactcacagggagccaggcagttatctgtagtaacaaacaataacatccataataatcggctccaaatggcaagagcttggttagtaactgacactttccctaatttatgttcccacttgcaacttaggaccaaccagggaaagccaaatatgcacccctaaccaagcacactggatgtcccccttctagttagcccacaggcagcttccccacaccagcagtctccaatcagggcacacctgaagccttccctttcctcagctataaagctgtcccactcctctacctgccttctaagctctgtcaaaatgcaagtgccggtggctgatgccggtggctgtcgcccttgcgtcagaataaataaccattgcttttttcatttgatgggccttcgttttcacactttgtcatctttaagcttttagccctttgaaggattctgagactggaaaataaatgaaaggatttttcaaagggggaagttctttttttaaaggctttattctggtcaattgatttccaagtgtgcaatgtcccatggggtaggccacaaagaggcctagagtgcgccatctgtgcggctgcagctcctggctctcaacagaactgagatctaagtcctcatgatctgatcagcttccgagggcctaaacctcctattaccaccaacttggggattaggagttcaacaaataaatttggtgaggggacgcagacacacaaacattcagaccatagcaatgcataaaggtagctcatcactgaagttttaatttgtgtttccctaacgagtaatgattttgaacatttttcttacgtcttttggggtcagtgggcaagatcaggaaaggggcagggaccaaaggagacatgaagagggaaacagcagggacaatgacacctcccaggagacttgtgcagaggcaaaggctggatcctgagagatgagaattgtttttgtcatgtatttgaatgggaagaaatagaaaaaggacatgaaagagaaaaaacacaagaacttgtagctatccaagaacaaaacaggaaaatatcgtggatattttttcatcaaaaatattaaaagcagcccactggcaaccccaggtttatggtgcaccatgatgatataatagttagtgctcttcattgtgaccgaagcaaccttggctggaattggagccacagtagcatctggcttccttcttggcaagatttggtatgtgttacagtttcactttttaaatccccttaccaactgcacccagtagctgtggtcagaaagcagagtttactgtgtctccctgtgacgcagtcaggacaagagaaggaaacccccacagtgcactaacctacggcagaatctttggggaaggttagaagggaccgtgtgtctgagcatgtgcaggaaccatctcaaaaggtaaagccctgactcttcaggagccttgtctgtagcttcaactgacataatggtgtggtaataaccatttttctggctgagatatttcaaaggtcagtaaggcctttttagatgcaatgacaatgagctttgtatgagttctcattcaacagggtattttacaataaaatctgatcatataaaacccaataaatgtaatagaacctaaacttgatgccatcctccacctcccccacctaattatttggcgggggaacgggagcgctaatagtacattattgaagtataattcacatagagtaacatgcacaaatcttaagggcatagaaacgtaaccatcgcctagatcaagttatagaaaatttccatcagcccagaaaggtcaataacctcctttagattcccatccaccttcctttcacttagacaaaccattctgatttctatcttcacagacgaatgttgactgcttctgaaattcacataaatgaatatacttttttgtgtctgacttctaatttcctgcagcataatgtttttgagatgcatccatgtttttagtatattattttggtgttattgatgactgttatttctgtgtggatgactgggttatttccaattctggctctcgtgaacaaagctgctatattctagtacaattctttctgtagacatatgcacccatttttcttcagtttatacctggaagtggagttgctaggtcatggagtaggtctaaatttaactttattataaactgccaaacagttgtccaaaatggttgtgctattttacctcctcaccagcaacgagagtatagttactccacattcttgtcagtacttcttgtctttcaaatttcttctattcaagctgttaaaataccttaaactgagtagcttacaaacaacagaaatttatttctcacagttctagaggctgggaaatccaagttcaaggtgccagcagactctgtgcctgatgagggctcactctctggttcataggctgtaccttctccatgtgtcctcacatggtggaagggcaaacaagctccctccagcctcttttataaagatactaatcctatgcatgaaggcagagtcctcatgatctgatcagcttccaagggcctaaacctcctattaccaccaacttggggattaggagttcaacaaataaatttagttgggggaggcagacacacaaacattcagaccatagcagtgcataaaggtagctcatcactgaagttttaatttgtgtttccctaacgagtaatgattttgaacattttttcttatgtcttttggccatttagaaattttgtgtgtgtgaagaaagcctattcatgtattttgctcatttttaaatagcttggcttttattattaatgtctaaaagttctctctaaatattcaatatttgagttatttttcaaataagcatactgcaaatatcttctcccagccttaacaaggcttgccttctttcttgtggtaattttttgataagcagtttttaattttgatgaaatccaattttcttattttttgtgacctctaagacatctttcctaccctatgattgtgaatatattttcctacattttcttccagaaacatgtttttatttttatttttaaatctataattcttcttaatttcatctcctgatctcagcacaatgcttaaccactataaaatccacaacttgcagaccaacagttcaatctcccagaaacttgtataacccttgatgtaacatttacagtagtttcctgctgtgctctttgacaactatagatccttgcgcttccaccccactgcccccttgccttctcccttctctctcctcttttcacccctacaaggtgagaaaaccagaaagacctaaaactgaggagaagaaagacctggtctaatctgtgctcaagatattagagcacaagaagaagaaagactgggtctgatctgtgctcaaaccacacctgtattctggtttgtaagtctagttctgcccctgtgtggccttggataaataacttaaactttatgtgcctcaatctttcttctgtaaaatggggctaataagagtagtcttaggccaggcgcggtggctcatgcctataatcccagcactttgggaggccgaggcaggcagatcacttgaagtcaggagttcaagatgagcctgaccaacatggtgaaaccccatctctactaaaagtaccaaaattagctaggcatggtggcaggcacctgtaatctcagctactcaggaagctgaggcaggagaattgcttgaacctgggaggtggaggttgcagtgagctgagatcacaccactgcactccagcctgggcaacagagcaagactccatctcaaaaaaaaaaaaaaagaaagaaaaaaaaaaagaaaagaaaaaagtagtctatttcagtttgccattgttagctgtgtctggatatggttgacgattaattagtaatcaatcagaatgatcttcctcattgtcattttcctctgcattatttttgaaagcaactatgctgatgttttgcatcttaaattagtttttcttctaagaattccagtagatggactcatggagtatgcccactgttatgtccagttccttctttctgcataaagtctctgagttttattcacattgttgagtatatcagatgttcattcctttttattgctgagtagtattccattgaacgaatataccacagtttatttgccagtgtcctgataatagacacttagattgtttgtagttttgggtatgtgaataaaactgctatgaacgttcttgttataatgtgtgtgtgtgtgtgtgtgtatgtgtatgtgtgtacatatgttttaaagtctcttggaagaatatctaggtgaagaattgctaggaaaaaaatgtttatgtttaaatgtataggagactgtcaaaccaaagtgattataacattttacattccctctaaaaatgtatgagttctgggtgttccacatcttcaccaagatttggtggtttctgactttataattttgccatgctaaaatggcggagtggtatctcaatcttgtttaagtctatttctctcacaactaatgatattgagcactcttttatgaactgactggccactagtatattttcttctctgaaatgtctgtttaagcttttgcccatttttaaaaatgggtgtaggagctaattgtatactctggatacaggttcttggtcaaatatgtgttgtgaatattttctcctcgtccatggcttgccttttcagttacttaatggtgtctttggatgaaaagacatatttcatatcaacaaagcctaatttatcatttttctgttttatttatttctctgtgtaatatttagaaaatatttgctttctgccaagtcttaaagacattttcatgcattttcttctaaaacttcatagtttgtatggtttgttctgtgatccaactcaaattagcttttgtgtatgttgtgaggtagggattgagatttttttcctcactagtagatatctagttggtccagcactactcgttgaaatgacacttcttccccattgtattactttagtaccttttttgaaaaaaaaatcaattgaccatataacaaggatctgttttaggtgtctcacttcagtttcatttatcaatatgtgtatccttttgccacattcacactgttttgtttatagtaataaacagcttaatagtaagtcctctaggtttgacacctcaataaacctgaaatgtgtacatcctatggtgccaccatgaaaatcaagacatgctgtcacttaatctctctcatttcactagaggacacatgctctcataaataatggttgaccccttagccaaagatcctctattgtaccctctggagaaaataaatctctagttaccttaagagctgatctagaggtaaaatgtctgcaacattcagcaatgaatttagattttctttgaaaaaaagttcattttcaaggtagttttttttgttttgttttgttttgttttttttgccaaagaatttcttttttttctgttacttagtagcgtgaagtacaatgtttggtttgcaatttctgttctttgtaggaagaaaaactttagtggaaacaaccagtacttaaagaccattttatgaggctgtcatttacatattatctcttttgctgtttttgttaaaatgatataaggtgggctttatatgctttctgtataacctttggaatgtgtatttaaattaaaaacgtaaaattaaaatattcatcctagactcaggttaagttccaccaacagtacacttaaaataggatgagcccaacctaagcgtacaacctacctgcttcaagtgtgtagttggtgtgtgtgatacattctcaacagtatttgtgttccctggtgtagtgattttcgtgttactcccacccttgaaagtcctcgacttaaaacccatctagaacatttcctttgctaagactttaaagtattctttcttcaagttaagggtagtttttaaatagttatcagttgcattcttggaattcacagaaagcttggggagaaacaatccgacggcacaagttcaagtgcccaacggggtggagaagggactgcatactcactggttgccaggccgaggttgtccgccttgcctgctttggctgagactggagacggaaactccattcaacagcgactggaggactgaaacggcgcaagagggcggctgcccttcacctactggtccctccctgccttggcgccttcggagttcggactgacccgggatgttgctggagccggcaggaactgcaaactcaccgcgcgcgtccctgcacacccgcacctgcgcctcgagaactcctggccagttgaatacccggtctgccgccgagcttcgctgcaggtcacaggaaaggggtgcagggttgcgtacccggcgggggaagccgcgcggagaggaccaggtgctgctactggcctccgagaagacaggcctagagtagctgattttgacctgcagggccaaagtctaacggcggcctaaaaccctaacgtctgggcgagccgcgggtagcgagttgaagcgatctctatgccttgcttgtcgtttgccaaaattcagaccaagaaagagaatagttgtgtggatcaaagtctgcaattaaccaaaaaagaaacatgatcctgtgttagcttacttaggaaaaaaggaagaaggaaggaaagaaggaaggaagggaggaaaggttggagggagggaagaaagatgaaaaaatcaaccaaaaaaagaacataatttcctaactaatcggatgtgggtcatgagagaaagacctgcgtccagtttttggcctgaacgtgtggagggtggagttgccattaactaacgtgagaaaaggcaggtgtagtacgttgtagagaaaatatccggaattccgttcagggccctggggtcttccttgaaagagttttccatccaggccgtctcggtttccgcatccgtctgagtcgtttatgatgtcgggaatgcaggaatctgagtcctttatgatgttgagggtgccacggtctcaccccgggcgcctccccgctccagcctcctcccggaagcctggtgcgctctggccccgccgaccagcgacagtctctccacgcgctgccgcctagcaaaggagcatctttaggtcggtagtgaggtgcggccgggacgctgcaactcgctccgggacttgtaaacctggcaggtgttcgaggagcgccactggctggaaggaaaggagagagctctgcacgtcgcgtgtgggctcgcaacttggagaaagcagggagaggacagccttttgggactattccttggatgggcgggtggcaccaggaagggtagatggagctttctagaggtcaatgtcagcgtactttctgctgaaacaattgaaggaggaaaaaaaaaaagtatgtgctttgtggttccctggtagtctagtggctaaagtttggcgctctcaccgccgggactggttgattccagatcaggggactgggtctcggcctcactgtgaggtattgttctttcctgtgtttgccatctaccaccgctgtggctcaattatttcaagactgctggagaaatggaattaatgtcgatcctaacatttaagctatttatctaggataaattccaaatagtggaactgctaggtgaaatttattgtgaatttaagattccgatgtatacagccctacaacgtataagcaccaattacattccccaaagtgtgtgagactgcgtcttttccccagaatttaaaaccaatgctagaaattatcagacttttagagataattttaagcttatttatcatcaaaggatttcttcatagtcaatttccccttagactataaatccgcaagagatggcaaagctggaagaactgcctagaatttcagcaaacttgaattcaatagtctctctgttctttcctgttttggcacctacccttttcttccagttaagattggacacaatagaaaaataattaataaatgtaataaaaatgtaagcctggacgttttgctcacagtgttctcactgggtctaaattttgtgaatgtggttccttggatggtctcatgggtatgcttgagactttaggcccttgggacacctggtgcacagaagggtcccaaaacccatctttggaagtgttggcagagtaaataggcaccagtaataaaggcaacggcgcctgaatacgtaaggctggtttaaaccaaagcagatttttcaaaaccagagagggcttgtgttcataatttaataatttaatttttattttgatgaaatttaaatttgatttaaattttcataatttaattttcattttgatggccactttattttgacaaagacactagtggaggaaagtctctttatcggatcatcaatttccctataaatctttgtctcagaaaaatttaataataatttcataataaattataataaataatgtttcacatcttacattattcacttttgatttagttggcttgtgctgtcaatatgttgcccactgtataacactacctgatgaattacattcaactatgtagtaatacatattactacatatacacacacacgtatacatgtgtatatacatatgcatatacacacacacatgtatacgtgtgtgtgtatatatgtatatataaccatatataatttcaaaaggtaaattaaatataatgggacagtgttggtaacctcttagatagtgtagggataagatagctgaatttatggcatggtgttgtatacttcagatatctatgctgtaatattaaaatggcatttccttggcccactaaattgtccacttcctggcccaatatgatacacgaaaggaatgaaaatgggaagaaaatagccttctgaaggacttgcctaataaacttctcccttagcattacttggagtgacatcagaaaattggaatgaagtaattgtgtaaaaaagacaaattctctgctgtctttctcccccaatccttaataaacaaaggaggaaacctagactcaggttaggttttctcttcttattctttacataccaggacaagtactgagcttgtttgttactatatggggacttagtgtattgtacaaaggggtgtggctattactgtcccttttctaccagagcatcaaaactggtaacttggctggtgttaaggggagcttctaaccttgaattcccactccatgtgacttctttctggttctctcttctcagagaacttgcagccatcagattcatttggagaagtttgataaaggtgactttacgcttagacagaagaaaaaaccctaaggtcttgaactaagccttatcctctgatacagtttactggaattccctccactgtggcacaagccctgccataaattgtgattatctataccttgtcagttttatctgtgtatatatcttttacagtaatccccacatccaccagagaacctaggttattggcagaatgaggtttgggaattttggtcctctggccagacactatcagatagtactctgattccaccatttttgaaattatatacaacaaattttaagtattgtttattttggagagttcaggttaaaggaaatgaagactattattcagtattatttctgtaattttgtaattttaaccataacataggtttcttatcaaaatgtatggaagccagaaagcagtgaagcaacaatattttctccaaaacaaacaggccaaactttggcaggagtgacaaatctggcatgcaatggtggcttctatatcagaaatcaagtcttttactttgtgagaggcaggagtttttagttctttgtcttccttttggctgccagaggaattgaacattgtgaattcattggcatagtcccaagaaactttacttggcaagcaagctattgattttggcgggggtgggatggtgtttatcagtcacccctactagcagagatgtgataacactgcagtcagagtagttgagttttaaaattttgacttgccaaccaacagaacattatttatatggtaaaacttagacatcagaggctacaggcactcaggctaaattctgacccattcattggtgacaaatgttaagggatttttgtcccattagccctttttttactcatgatggtactctgaacagaagaatctcctctaacaatttaagaccattcattgtataagcatgtaaatcatcaatctcaatgacacattttcacaactatacactgaattggctcagaggcttcactcataactttaactttttttccccctttactacaagttttacccaaactctgtcagttgaattcacactctacaggaacacatatcaagaagtttaacacatgcactttagttacagcagcacctgccaggagaatatcttacctccttgactgagagttcaaggagtgcagggagatgtgaccagccatcaagaagcagtagagagacttctttccttaaagtacctgagtcaggttgaggggaagagaagaattaggagcacaaagagagcaggcacacaacagaaagcacaactctgcaattgcttttggttttaagaggctgtccattcagtttttttttttttttttttttttttgagacggagtctcgctctgtcgcccaggctggagtgcagtggcgggatctcggctcactgcaagctccgccccccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccattcagttttttgtttttttttttttttcctttttttgaaacggagttgcccaggctggagtgcagtggcatgatctcagctcactataacctccacctcctgggttcaagcaattctcctgcctcagcctcccgagtagctgagattacaggctcctgccaccatgcctggctattttttctatttttagtagagatgaggtttaaccatgttggccaagctggtctcgaacccctgacctcaggttatccacctgcctcggcctcccaaaatgctaggattacaggcatgagccaccatgcccagcctgtccattcagtttcaatgaactttaaacaacaaaaaatgccatttgggtggctggtttcagtcttccctgtcaatgctcagcctccaaatattcactaacacacagaacaataggaggactgttactctcctctcacacctactacgtgggagagaacatctgctaccagatcctggaggcccttctcaagccccctaacctggccccatgtggttctttctgttttttctcctagaaggcattgtgaccttactggtcccatgttgggcatcaaatctgtgaatggctcacacttggacttacgcacacagcataagtaataggggatatctatgcataagaaagattagtatgttgtcagctccccacatccataattccacagcatgacaccaaactggagttactagatgacaacccaagtggtgggttgctctgtcaagaaggggccaattttatattgcagctaggcagttacagtctgtagctgtaccattgaggggatcggggcaagatggaaatttccatggtttaccagaaacaggtgagaaactgcctgctggtagcctgctgcaagacaaggaggcccccaaaagagatgagtaagaaatagtattatgataatgcctcacaagactacttcccttaccatggtccaggagggcatttggtcaaggtttgagtcatagtatggttgagccttacctatgtaaagtttaagcaaagccattcccttgtaccttgtaccttgaagagagtttcattggatataatatccttaatttgcactttcttctttttaatgagtaaattgcattttattttattttattttattttattttattttattttattttattttattttttgagatggagtctcactctgtcgcccaggctggagtgcaatggcactatctcggctcactgcaagctccacctcccaggttcacgccattctcctgcctcagcctccggagtagctgggactacaggcacccgccaccatgcctggctaattttttgtatttttagtagagacggggtttcaccatgttagccaggatggtctcgatctcctgacctcatgatccacccaaggagtctctctccctccttgtgttctggtctgtgaatggctcacacttgaacttactgtaggctcctagtgggaggagcgggggtggcgaaaatcctcatcatatggataaacataacccaaacctctagaggtttcataattttcctcttgcttctaaaaacatagtcatgtcttatggggtgttatgtactttatatcttaacattttccacttgctgcttcttggtttgaggggagaaatgccagcatgtggcaaatggagaataagactgatggaagcctcagggcaaggccttcacttcccagtgacactgttcccaattccctccagcatgagctgagcctcctcaggctgtggttgtgcagcagacagggtgtgaggaaaccctgctcagccctggttacccaggatggcactgagttctaaaacgcaaaggttatgtggtgaggggcctggctgaagacctggtgtggtacttttgtgagcagtggcaccatttgaggctgggtaggagagaggtgcagggcctagctccccaaaagaccaacagataaactggggcagagagagagattccagtgtaaccgggaaggctgcagatcataacaactatggctgctgatttggcatcaaagatgtggcattgtcaaagccacaattgttgagaatggcaccaacatgctgcagctggagagagtgggtgaccaacattttgaagtggcatagttgtctggggtaattacccaaggtttgttgcctcacaccaagggaactgaggatgtggacacacaagaagtgggtttaggagtggaggtttactaggcaaaagaaagagaaaggaaaatagctctctctcctgagagagagagggttgccagagtggaacttctggttttgtggtgaagtgcacagggttttataggctggcttgaggaggcagtgtctgattcacatagggcccaaagattggttggaccaggtgtgacatttacatagcgctggaagaagttggccacccaaccctaatcttcttcttatgcaaatgggttttctactttactcatgccatgttgtctgctccttactgtacacgtggttagaaaggaaaagggaagatggagccaccatgttgaacatgcctatcccccaggtagccttgtcctattggcacagccgccagcagtcacctgtgcaagcttccagcttgcttatctatgtctgcagctccattttacaggctgctttttgttagaaaagaaattatttgggggctgcttttcattaaaagggaaccttaccaaggacttccttaccctaatgcctaaataatttctttttaactcctatatcaatttgtttgaagaacagatgacactttgaatggcccagcccacagcccagaatttcaagggaagaccttgaattcaagggagacaatgtctcccgtaaaatcacctaggcacttacatagcatatttttctgtccactgtcttgctagtctgttgtagttctctctgttggccttgtaggtgtggggtatctctagcaccagaggatcattgaggttggggatgcagggcagtgagcagatggacaagagaacttttgacagtcaatgctggagaccactgagaccataggatgtcgaagcagatgctgtcattgctattgatattggggtgataaattttggttgtgaaagcaaccttgggggcttgaacaggcaatccgtaggaaagtggatggtcaggaagaaaacacctccttggcaaggactgtcattaattatcacccagaggccccgtggagcactgggcaggaggattcatctgcaagttggttaattccttctggatccactttagtgccatcctaccccactgctgggggctggggtggcccagccacactgcactttctatatataagttttttgaaaatgctgcttcactgttaccttgccttgtatgttagtgcccatctaattcagttgctgttgtaacttgttccacagtgatgcctggagacctgagtatgttttatctttaaaatctaataattttactaggatattgtcttgaagttgatcatcctggtttaatttttgctgccactttatgggctctttcaatgtgcctcatcacataagtaatgtcattttcatttttgtaaatcaagtctcctagatcgttcacctgaaagcctgattctcctttagagaaaaaaatgctaaaaaacaaaacaaaacaacaacaaaaaaacaaaacattatatatcgcattacaattttattcaacaaatacagagatttccagaatagttaaaacaaagtagaaaacaactctggtgttataagagcagtaggttcatatgcccactgtgcagtaatagaccaatacactaagacagcagtttgcaacaaagaatttaatgatcacagggcagccaaggggagagatatgagtagaccctcaaatccatctcctcaagaacttctgcgttagggtttttaaggggattgtggagggtgaggggttggaaaattaaggttgttgattgggcaggggaagggggatgaaatcattaggatttggaaactgcatactgagtcagttcctcagtggggtccttcagaccagctgacatcagtagtttcactggtacacaggatctgaaagaatatctctaacgggaaacttaacatttcataatcttcaggttgttatctatagaacagttcaggagaactataatctagggcctgcctgattctagcacaaacagcaccaaacaactgtgaggaagcaggtccaagagcaggctgctctcaagagtaatgcaaaattgctgcaagcttgtttatttttgtttctccccttcccttcttccctgattaattttataaagtttatagggacagtttcaatggcttcaacacagtattgccaggtaaggacttgaacccaagaggcggaagttgcagtgagtcaagaccaagccactgctgcactgcccagtctcaaaaaataaaaataaaaaaaaaatcaggccaacacctgttgacacacattgctaggaatccctttgggaaagcaaatgggctcacggaacacacggaggccatggtgggtgacaatgttaactaattctgttcatggtgtccagggtacaggcctgagggtccactcgccacctctgcccaaagccacgtctccactgctcccctcatctccgcacggattcctccccacgtgcctccccttttcttggactgccgacacctgacaccaccaaggtgactgctcctccccacagcttctctccttcaggggacttcacttcttgttccttgctccatagtgaggcgtgacccagcggtcagcccaaggtctagcatgcgaatcagggacgtgatggttctttgggattctagggatctacctggaaaatagatgaaagtaacaaaagttttacataccaatattcaaaactgcatcaaactaccagaaacacttgccactttcaaagatagaccatgctaagtagctccaggtgtgtgccaccatgcctggcaaatttttgtatttttagtagagactgggtttcaccatgttggccaggctggtctcgaactcctgacctcaggtgatccacctgccttgacctgccaaagtgctgggattacaggaatggctcttgactctaactgcaaggtccctaaatcattagatcatttcctgaatatcttatgcttcaggcattggccatcacttgggttaccattgtcataagtcaaaagcctccacaaccaaggcccttaaacatgggatagcctgtgcagggcagaagtataaagaatatagagaagtgaagcacaaaacttgttgcattggccaggaattaaaccagggtctcctatgcaggcggtgagaattctaccactggaccaccaatccggctcttatgtgtggtcctggagaaacaattgaaatacaatactgaaaaagacagaaattgttccaaaagaagctttttgcagtattgactaaaagctaacagtagacatccaaaaccaaggtttttatagaatacttttactagacaaaactataaatattaaaatagcttatttgatcaaactttaattcctaaaaaggctccttccaactgcgtaacagactcctatagaaaaacatcagaaattcatccgggttccttgtttctgatcctaaatcttcaatttaggacctcaacctcaaactgttgctttagtggctctgggaagaaagcactaactggcagcataggtaagtaaagttttaatctagggaagaaataagaagcagaatcagaattagaattagaagaaagaggaaatatgctataccagaatatcataggcaaaaaaagaagatgaagaaagaggaaatgaaaggacagaagacaatgctaatggagttagttatttgtggctgttttttgtaaaagagtaatgatcagtcttgtaatcattataatactattatttgctttctaaaatgtctaaaatatttgaaggaatatatgatataaaaagatgaataatgcttgcagtcagtgtttcattgtttgggagaacccagtttcctcagttaatacattttcgtgtaatagctgtttaaggagtaacatggtttaaagacattttaatggctgaaatattaacatgttggtcttttgatgaagttcaaatagaggatttctttccccaattttccctggaaagattaaactgaagagaaaaatctggaaagtttgccccacctgttgggtctgggagtcattatgactttttcaacgacaggagttgtgtatgacatggaatcatgcttcttctctagttgagaagccaagctaggtccaggctgagtcataaacttgaacccaacaaggaaatcacccttcatattgaccttgcagagctttggctctatctgttctctgcccaacacccaagacacatactagttctggccaacaaaccttcacatattgtctgtgtcaaccagagctacatttattcccaaatctctttctaaaatacaaacctgtactttctactctcaaccccaaaatttacaagaggcctcatatgcatctcagagtcacagatgctaaaactcaacacaccagtgagatccctgtcagcatcatgtactaccctctacctcaatgatcagccccaagccagcatctcccaaagagtagtgtgttgtcgtgggtgtttcaacagatcactaaaacctgcttctaccgctgcctagacacctatcctcactgctatgcatcctgctcctcaaatcagatcttgatatcttctttaaacactcccaatctcccaacatgacaattcatttccaaagaattatagtatttaaatttattggactctatacagactcattcccactttgttactacgctggtccatccatcacctccattaacataagtagatcaaaaactggcctctctacagccagtcttgtctattccaacccatttgccacactgtgtcctgagtgacctttccacagtgtaaatctggacatacctgtagccttaaatcatatctaccaacatagtagccaagcaacagcaatctcttttcctttggtcattagagtcctagagaccaagaggatgttgggaaaagaattacaatggatcagctctcagaggcagtgggttctggactcgtgctggctttgatacgtgtacattggaaaagctcaagtacctggcaatacttggagattaggaagaaaggatgaaagtaaaccactgcactaaataacatgacaataatcacttatacaaaaattttaaagataaggaatatttaaagatttattagtttattatagctttatagttggagagtggagaagaaaataccaaagctttttgtcttaacaaaatggtgcagacagattaacatatattgtcacctatgataaccagtcagcataaaaagtatttagaaaggaatggttgtattctctaagagggatattctgatgtcatgttttttgctttagagtctattaatatagccacctttttgttaatgttttcagtcaagctccttttctcgcctttcatttccaacctttctctcactttctggtttagatacaactcctaaatatgtcatatagttaatttaaaaatccagtgtagcagtatttcgggggtttgttttactggataatttggtccacttacatttaatgtaattgttgatatatattaattttaaatctaccatctttattttttctgtttgttctgcttgttctgtttctatgtcttttcttgtctgttttggattggttatttttaactattataacattatatttttttacttttttatatgctttgcttcactttcttccttattgtatttcctttaattgtatttaagttgcttctattcttttgtggttactttaaaaattacaatcttaatctttaattttttttttttttttttgagacagagtctcactctgtctccaggctggagtactgtgccgcgatcttggctcacagcaacctctgcctctcgggttcaagtgattctcctgcctcagcctcccgagtagctgggactacaggtgcagctaatttttgtatttttttagtagagacagggcttcactgtgttggccaggatggtctccatctcttgacctcatgatccgcccaccttggcctcccaaagtgttgggattacaggcgtgagccaccgtgcccagctaatccttaatttattaaacatagtagtaattgataccgttatcctcttcctggacaatatatggatgttggaatacttttattccatttagtctcattctatatatatgctgttatcatttattaggtctaagtattaatagttttaaaccccagaagactagacatatattttatgtagttaatgttaatttagatttatcaacatatgtgctgctatcttgctctttatttctgctatgtctctgaatttccatatgtaatcatggtccttctgctggagaaacatcatttagaatttccttttgtgttggtctgcttgtgaaaaaactgtttcagctatttttctctgaaagtgtctttattttgctttaattagtggagattatttttactaagtatgtaattctggaggcagttattttctttcagcatattgaagatatttgcatttgattgtttctttcagaaggcagccaattgtctcgctgctgcttatttgaatgtaatgttcctttttttcctctgttttttgtctttactatttttgtctttttttttttttattgtctgcagttttactattctgtctttaggtatggagttccctttatttatcttctttgattggtaggccttctagaatctgttgacttttgagtttcattttgtctggaaaactctcaagtattatctcttcagttattgcctctattttctctctcttctacttttgagcctctaactaaaaataaaatagactttctcactctatttgttatatttttgtgtttgtgtattaaatattattttttctccttgttatatattctgaatttttttcttcttcctcatctgccattttactagttctcttttcagttgtgactgctctcctgttaaactcttccattgagctcttaattttgttttgttttgttttttccgaatttctatttgcctctctctaaatctattctgtcatttttttgttgtttccaattggtgtgtaaattgttaacaaaacccttttctccttctgcatgataatttgaccttaattaactttctagctctgtccacctagagccttctaatgacaaaatgtcaactatgttactaagcaaacattgcatatcataaaaaagactcctaactgatggactacacttggactgggaaaactaagtatctggaagaagccagactttgagcttctctgaatgcagtgactcctataacttgcatacacctggcatgggcattggaaactactctattaagttcttaacaagagataatggctccaggatggtgccacatgcacctcagctgtccccaagtagacaatgaggggtggagagtcaagagactatctcctaggtactgtgtggactgctgctgcagggactgctcctatagaaatatcatgcctgatgctgccctaatagcaagctataattcttatcctacatctctcggattaatctggtgccaagtatggcctctgagattcttgtgagcctgaacgttaagttgaagctaagaaaacatccaagtgggcaaaattcttccaaatttttgtttcatgaataatgtagacatcattgttttgcagtctttctaatatatctaatatttgggggcttgatttcaactgcctgacatgtctgctggttttcacacctggtttagtttctttgggttcattattatttttgagtatgtgccatatcttgtatctggaaaaatatttttggaataatctgagatctacaatgaaagctttcttgcccagcacctgggggtacttccagcccagaaccacctttaatcaagtaaaaggtgtgaaagatgctctgaacttaaactgtgtaacataagggatgtttcttttatagtccatttttatcccaagattatagaaatgtaaggttctaccttattgtaggattattctcctgataaactccccaacttgggcagactctggtcttctatttctgtcccattagtcacagaaggctgtcaaaccctaatatgcaggtcaggaaatgtccttagccaaaaaatggttcctctgcttgcttacggctctgggatccagtttttcctttacttcaggcctcgtaattcttcagtgttaatcatcatcttgatgcttttaaaaatatttgtttcctatatattacctaaatagcttagtcagtgttaccagaaatgtatcatcaacttttaaaatatactaaatgcttaaaaaaataaagtcatattttactgctatggctctgacttgaaactaagttgatgaggccatgagctggagcacaaatcagtccccccactgtgaaactgtcaggtcaccacaaatacagattttattagcaatgcagaatttttcttttccctcttaagtcatccagtgaccaatcggttctaggccacaagatcaaaaactccggtctcaaaatctaacaacccccagctggtaatctcacacatgctcagattttactttgtaaaagagaatcaagccacatcatataaaattaaacatttattatttttcttaatagtctaatagagatatacatttgtgtatattggccggaaattgggctaaaattttcacaaatggaaatcaagaatgttaccatagaactatcaatgccaactttaactatctgaatcagatggcatagcctagtttcctctacaactgacagcacactctttggtattttggtatttttcagtgtccttgaaatgtttaactacccactaaagaacaggtcacatggaattaataaacaaagggcttcagtttccatcaagcaccttcaagtgacaggaacagggatttaaataaaaggatctaagtcagcacaggaaagtgactgtgctgccaaagtgactcaaactcaaaaggacaggatgagacttactcagaacttcgaggaagtgtagagaaattatccaccactttttatcctagaggtgcctttgtggttgtgaccataccgtagaatgatttggggatcccttccaactggaaggacatcttagactgagggaacccaagaaacctgatttcggtcacccctgaccatcataaatcccatgcaacaggtccatgcattatctaatgttgactctgggaatggtcattgtcattgtttcctatttgaatggttgtcacatttcctgcttcaaatgatatccagaaatgatggcttgggaccatattctcaatttttaggtggcaaatagactccagagacatcacacataataaaatacttggactttgaaaggaaacagtcaagtctatgacttacaagcttataaagatccctcagatgagttatgtacatggattgagaatcagaaaaggaaggatgctctctcaggagatagaaaaaccagataaaaggagcaactgaaattatctgacccatcccctcatcgcctatgtagaagggaaatgctcactttatctaaccagtggataacagacagcctctttcattttggagctaccaaaaagaaaaataaattgtggtttggttcagttcccttttgaccagtatgttcttgaaattttgaaaacattttactctttttccttttagtgtttcagtgtggataatttcatttgatctattttcaagttcattttttaggccaaaatttgtcaaatattggcaatttcatatgattcaacttaatatattaacctaatgtgcaaaattcaaatttgtttctatactactaaataatatccccctgaaacgctttgccaatttactcctactgacagtgtatgaaaatatccattttatttcatcctttacaaggtgctattatcaataatttatacttttaccaatctgggaagtgaaaaagacatttaattgtcttgacttgcatctcccttattactggttagtttaaatttctattctccgttcatttttctgtttattttcttttgtagtacctactacttcttgatatctttgtttaagctttatatatttactttttacctgttaattgttgtaatcacccactaaagagtaaattctggctgggcacagtagctcacacctataatcccagcactttggaaggcccaggtgaatggatcacttgaggccaggagtttgagaccagcctggccaacatggtgaaaccccatctctactacaaataaaaaaattagccgggcatggtgatgcacacctgtgatcccagctacgcaggagactgagacacaataatcgcttgaaccagggaggcagaggttgcaataagccgagatcacaccactgcactccaacctgggcgaggaaaaagaaaaagaatcagttccatcagagcatggattaagtctcattcaccactctagtgcctagaacattttatgtactcaacatataatagttaaatgaatgaatgaaagttagactgtaggggtgtccatgaaagtagatattagctaagttcccagagattgactcctcttttcctggttctcacacttcaagctctgttaagcctggaggagggtgttttgtctttaaaaagatacagctccaggttacccctttggaccagttcctgttcttaggtctcagacttcctctattcatgaatggtggatatatatgatttcctgtgatgtttctttacattatgaccataatgagcgttgatttttagttcctgatcccctcatgtaatgactgttcaattaatgactttttgccataatggctattataaagctatgtcactttttggacaactccttttttattataatgatttgtcaccccaaaataaataaacatgctataagaaattatattttgacatcatggtttcaagcagacactatatagaaggatgtggccgggcacggtggctcacgcctgtaatcccagcactttgggaggccgaggtgggtggatcatgaggtcagaagatcgagaccatcctggctaacaaggtgaaaccccgtctctactaaaaatacaaaaaattagccgggcacggtggcgggcgcctgtagtcccagctactggggaggctgaggcaggagaatggcgtgaacccgggaagcggagcttgcagtgagccgagattgtgccactgcagtccgcagtccggcctgggcgacagagcgagactccgtctcaaaaaaaaaaaaaagaaggatgtgtatgaatgagcaagtagggaagtggccaaagaggggcccaccctctgtaatctgctttttgatgctaaggtgaggactctgcaaaccacatcttttttttgcttgctggctttattagtttctgtcagtaaggggtgttaaaaagagactgaaaggctggaggagggatataggtctggctgcttcctattttgtttcttgtttcaattagcatcatcccagccataattttttactctgagagtggtcattgtttccagtttcatttcttttcttttcttacaatcccggagcctcatggccccctctcaaaggcatgagcatcagccagtggacatctcttcttcagaggtctgagtccctgctacactaggtacttcctctgagttccaaggccagcagcaacctccttctcagaagccatcctcccagttatgtgtggcccttcatccaagttaccaagttctaacaacccaaccattttacctttgtttctacaaccctagggttgatcactgcttcgctttctacactaactatctctgtgttacatcagttccccttttgccttcttagacctccaatacctgtataattccttgtgttaaattccctctggtatactgttcattttctattttttttttttttttttgagacagggtcttgctctgttacccagactcaagtgctgtggtgcaatcatagctcactgaagccttaaactcctgggctcaagtgagtgtgccaccatgcccagctaatttttattttttttagacacagtgtctcactctttttcccaggctaatcttaaactactagattcaagtgattctcccattttggcatctcaaagtgttgagattacaggtgtgagccaccatgcccagcccattttccttttagaccctgaatgacacacagtactactcaccaatttacctgacatgaccatttgtagtcagagaatattgtgtgaaacaactttgaattgcatgactgtattagtctgttctcacactgctaataaagacatacctgagactaggtaatttaaaaagaaaggagacttgattaactcacagttcagcatggctggggagccctcaggaaacttacaatcatgacagaaggagatgcaaacacatccctcttcacatggcagcagcaaggagaaatgcagagcaaaagcggggaaaagtcccttataaaaccatcagatctcgtgagaactcactatcatgagaacagcatgggggaaaccacccccacaattcaattacctcccactgggtccctctcattatgtggggattatgggaactacaattcaaaatgtgatttgggtggggacacagcaaaaccatatcattctgccctggcccctcccaaatctcatgtcctcacattttaaaacacaatcataccttccaaaagtcccgcaaaattttaactcatcccataattagctcaaaagtccaagtccaaaatctcatccaaaggcaagtcccttctgtctatgagcctgtaaaatcaaaagcaagttagttacttccttgatacaatgagagtacaggcattgggtaaatacagccactgcaaatgggagaaattggccaaaacaaaggagctacaggccccaggcaagtccaaaattcaatagggcagtaattaaatccttaagctccaaaataatatcctttgactccatgtctcaaatccagatcacactgatgcaagaggtgggctcccatgatgttgggcagctctgaccctgtgactttgcagggtacagccctcttcctggcagctttcacagctggcattgagtgtctgagtcttttccaggtgcatggtgcaagctgtcagtggttttactagcctggggtctagaggatggtggccctcttctcacagctttactaggaagtgtcccagtggggactctgtgtcggggctccaaccccacatatcccttctgcactgccctagcagaggttctccatgagggctctgcccttgcagcacacctctgcctgggcatccaggcatttccacacatcccctgaaatctaggttcccaaacctcagttcttgtcctctgcacacctgcaggaccaacaccatgtgaaagctgccaaggcttggggctcgcacccactgaagtcatgactcaaggtgtaccttggccccttgtagccatggttggagtggctgggacacagtgcaccaagttcctaggctgtacacagcagggaggtctctgacatgccctgaagaccttttccccactgtcttggcgattaacatttggttcctcattacttatgcaaatttctgcagccagcttgaatttctccctagaaaacaggtttttcttttctaccacataggctgcaaattttccaaatttttatgctctgtcacctcttgaacgctttgctgcttagaaatttcgtctaccagatactctaaatcatctctctcaagttcagaattccacagatctctagagcagggggtaaaatgctgccagtctctttgctaaagcataacaagagacctttcctctagttcccaactagttaccatttccatctgagaccacctcagcctggactttattgtccatatcactatcagcattttggtcaaagccattcaacaagtctctaggaagttccaaacgttcccacatcttcctgtcttcttctgagccctccaaactgtttcaacctctgcctgttacccagttccaaagttgcttctacattttcaagtatctttacagcagtgccccactacccagtaccaatttactgtattagtccattctcacactgctaataaagacatacctgagaccgggtaatttataaaggaaagaggtttaattgactcacagttctgcatggccagggataccccaggaaacttacaatcgcggtggaatgggaagcaaacgtgtccttcttcacatggcagcagcaagaagtacagagcgaagtgggggaaaagccccttataaaaccatcagatctcgtgagaatcattcactatcatgagaacagcatgaaggtaactggccccatgattcacctacctcccactgggtccctcccatgacatgtggggataatgggagctacagttgaagatgagatttgggtgaggacacagccaaaccaaatcaatgacatatttagatgaacccaaaatactgtttttcatacacatgccaagcaaagtgaatgagagggttgcatcttctatgactcttcaatctgctgtacatgttcaccatttcaatattctataaagcctttttgtgtttagcttttatttggtcaaagccttaaggtaaaggaaattattaatcacattaaatttgatattgaatgctggtctggcactgaatcttcactgactttgaaagaataatcccctcccagtcctcctctattgaccatcacctataaccaagtctcctcttcctcctttgatgaatacaataaaaattcatatgtgaaaactgtatttattttatttttatctattatttacataaatttagtttgtttaatctatatgttttctatcttttgggtatcttgggttaatttttctgtttagaataacaaaaactttttattcacttcacatattttcacttagttgtaagattttcaaacataaagtcattaagcaaatgtttgtgtacaagacacacagatacagaaactgccaggagagactctgataacttccatacttctaattttgcatataagctgtcttcaggatacacaaagactgagggaagagaagatgctaaatgtaaataatatacatttatttatgtattcattatcaagcatatgttatctgaatgtctttataaagcaatatacaaatagaataggaacgtgatatatttacttccccagttgtggtgtaagcatcctctaaaaatgcttacaccacaattggggaagtaaatatatcatgtatataacgaatagactataaaaaagaacacatggggcaggtacgacggctcatacctgcaatccagaactttgggaggccaaggcagatggatcacttgaggtcaggagtttgagactagcctggccaatgtggtgaaaccccatctctattaaaaatataaaaattagccgagcgtggtggcacaggcctgtaatcccagctacttgggaggctgaggtggaggatcccctgaacctgggaggtggaggttgctgtgaactgagatcacaccactgccctccagtctgggtgacagagtgagactccatctcaaaaaaaaaagaaatgaaaaagcaggaacacatgatagggtagtctgagctctgtacaaataggaacagtaacatagacaaggagtaattagagtaggctgaaaaaaaaatcgaaagatcttcttgaaaaagatcctgaagaaatttatgaaactgagttgactaagggaataaggaagcacgtgagtaaatacagcaacattacctaaattccctttccatcatctctctgtcatcttctcccacctctcctaaccaacccacagggatttaaaaatattattgaatttttatctaaatgtgatggaggatggacaggaagagaattactgattactctcagtcaggattcatcctagcagcaattatttgtaatttaactgaaataagtccatttgactgaacagacagcttggaaatcactaaaatgagaaaggagatgttttagagagtatgacttctataagtgaatgaaagagaaatcacccttaaactcactggtttggggaagtgaagttcccacaaatgtgacacacaggaaattgcctttccacatgtgagttttctgaactgaaccaactgccatcgatttgcactagtaagacagtattcctaaccaaagcagggaaaacaatgatgtgatcccaagaagtccttgcactcccagacttctagtctcatctgtttaatttgacattgtagggaccaagaaaaagcttccccttctatcctctgaaagtttgctgaaaatggactatagacaaattaataggagaaaaagccatacaaaatgtatttaacatgtatagctcaggggaattaaaggaggatggttacccaacaacccagtaaggtccaaatggttatacacccttcctcatagagaaaggggagatgaagggtgtagcagtaaatggttttcagggggaatgagtgaacccaaagaacagtgatctgggacaaagttcctctgagctctggggtcagtggccagaaggtgaaggacagaactttactgtgaacaaaggttgttttattattcagataaagcctctcaggtactctctctgagctgcccttggaggaatacatgaaaagtctgtcagggcaaggtgaggactcctagtttcttctcttgtggttaatctttcctggttatttcatgagattcctagggagggagttttaagacaattgcatttctattttattttattttattttattttattttattattttattttattttattttattttttgagatggagtcttgctctgtcacccaggctggagtgcagtggcacaatctcaactcactgcaacctctgcctcccgtgtttaagcaattctcctgcctcagcctcctgagtagctgggactataggtgcatgccaccacactcagctaattttttgtatttctaatagagatgaggttttgtcatgttggccaggctggtcttgaactcctggcctcaagtgatcctcctgcctcagcctcccaaagtgctaggattacaggcgttagccaccgtgcccagcaattcttttggaaagaatctttcttagtcagctgaggaaattccatagagagtccctgctagtgcttcaggaaagtaagaggatgggggtgaggtgtaggtaagggtgaggagaggtcagagagagataccttgaggctgcttctttagttcagcatgtcaaagtgccatattttggggtattgttttctgagccccagcagcatcaaaggtcatagttcctgaaactgcagagacagcactgaagacttccatgtaggaaacaggatgtctctaaagtgcaaagagccaggacttggatctagaagtgagtagtagaatgggaaagaatctagtcgtaacttagaaaccacctcagtccttcctgggttagcatttgtcatcgtttacttaggctgctgctgaagggatttgattcaagcctctgtgactcagcagtgggcacaagcattgctatcccccttttttctaggaaaattgttcaaaagaaaaccttgacacgaactacgcattaaccctatattacaacatcttcatagagtcaggtgagaagaagggaggccagaggatccagtcttgaatgctaacggtatcttaaacagggtctttattgagttctaccttagtatggtaaattatagttgtaaggagaatggtctcccctttgtcccttttgactacaagaagccggtgctcaccctctgaaaagtcagaagatgtataacatctgctactcctaccaaatgctaagccactatgaggatatgatgctttatttttatttatttatttatttagagacagagtctcactctgtcacccaggctggaatgcagtggtgcaatcatggctcactgcagcctcaaactcctgggcacaagtgatcctcctgcctcagcctcccaagtagctgggattataggcatgagccaccaggctcagcaatgcttatgtttttttgtgcgtgtgtgagacagagtcacccaggctgaagtgtagtggcacaatctcagctcactgcaacctctgcctcccgggttcaagcaattctcctgcctcagcctcccaagtagctgggactacaggcacaaaacaccacgcccagctaatttttgtatttttttagtagagacgggatttcaccatattggctggtcttgaacttctgacctcgtgatccacctgccttggcctcccaaagtgctgggattacaggcgtaagccaccgtgcccagccaacaatgctttatttcttgactctctttctacacccctactgcaaaagactaattttccccaaagaggacctgattttgactgaattttagcctcttcctcttccacatgataaagctgctaattgcctgagagaagactgctgagttacagtgtagagggaagcatactcagggacaattagcaacaattctgtttctgttaaaccttataattcttatatcactactgcacagaactagacatggagctagtttatgtctcactgtaccatttactaattttttgaccctgatgaagtaacttaacctcttgtagctttatctcatgtacaaaattgagacaacagtaagatgttctcatctaagtaaaatgttgaaatgttggagtgttccaggcttgtttagatagatggaaaacacacacacactcattcactctctctctctgttactctgtctttccaataagtcttgttttcacttcttaagaatcagcctagaggtgactggaggaagagaaactaagttgtggtgacaaagaacaagactatgagtaaggatcactattacccttacagactggataaaaccctaagaaacaaaatcattgtgcaaaacctttcaggccaggcacagctgctcatacttgtaatcccagcactttgggaggccaaggtgggaggatcacttgagcccaagaattcaatgccagcctgggcaacataagaagaccttgactctacaaaaaatataaaaattacccaagcctggtagtgcatgcctgtagtcccagccactcaggaggtgggacgatcgcttgagcacgggaggtcaagcctgcagcgagccatgatcatgccactgcactccagcctgagagacaaagcaagaccctgtctcaaaaaaattttttttcaaggaatagaaccactgcacatgctcctcctgatcccccaaagtgtaagattttcctgcaaatagctatctcccaggacttacattagtaaggtatctggatataaaaatcagtgttccctaaatcagctgtgtttccattatatcaaaaataaacttttagaaattaccatttgaattaacaaagatacacacacacacacgcacacacctagaaagaaatcccgtaagatttgtgcagggcatttatgaagaaaactgtgcaatttatgggaagttattaagaaagaccacataatttaatagatacattaagtttatggtttagaagactcaatgtcattaagtacaaattttcttcaaatttgtttacatattcaatgtaaatctaaatcccaacaaatactaagaaagctgacaacttgattcaatgtgtacattaatgagcaaaaatccaagaataactatgaaaatcctgagatgattaaggagatgtgcactaccatatataaggatgtattataaagctataatattaagacaatgtggtattgagacaaagataagcaaattgctggtcaaatagcctaagctctaaaaacacatatatatgaaactttgtgatagaattgtcagttcatatcaaaaacaggatgattaggtcttttaaatggtactgacacaactgcttatacacaagggaaaaaaaagaaattagatacctgcttcacatcacctacagacatggacttaagacttaattgtaaaaggcaaaactttaatacttttagaagaaaatactttggaatcagcaaagatttcataagcaagacaaaaatactaatcataaaataaaatactgacaaattaaacctcatcaaaattaagaacttttgtacatgaaaagacaacataaagaaagtcaggaaatgagttgccaatcagaaaaaaataatttcaacagaagtaagccatgagggtttgtatcagactaaatttttaaacctttataaaccaataagagatagacaaaagtgcacactatgaacaaaataaaagccacaaacagatatttcatggaagaaactgcataaatggtaaattaacatatgaaaaaggactcaacctcatcagtaatcagggaaatctaaattaagtctaccatagagtactattttataactacaaaaatggaaatggggactaagaagtcttcttacattatataaaccaaaaataaaattgtaagaccccccaagcatcttaatggacccctcctcttggccaagggcattccaaagtgaacctgaaaaactagttaaggccatgatgggaagggggagctgaacatgcctcatcataccctcctcccttttggaattactggtagaacagactctaagtctgataaaaaaaataaaaaataaaaaacatttacaatctattctctctgaagtctgctgcctggatacctggaggcttcatctgaatgacaaaaccttggtctccacaaccccttatcacaagccagatcttcctttctattgataataacgaattgccaatcagaaaatctttgaatctgcctatgacttggaagccaccccacccctgcctgctgcttccagttgtcctgcctttccaaactgaaccaatgtacattttacatgtattgattgatgtcttatgtctctgtaaaatgcataaaaccaagctgcatcctgaccaccttgagtacatgttctcaggatctcctgagggctgtgtcacaggccattggtcactcatatttggctcaggataaatctcttcaaatatttcacagagtttgacttttttgttgacaaatactaagtgttgacaagggatttagtgacatagaaatccttatatcctattaatgacagggcaaagtagtatagccatgtagaaattaacttggcatcatcttataaaattaaaaatttacacatctataacaccttatttttctttcggtaccttttaaagatgttgttgctacattgtcttctcacttgcattatttccaacaagaaatctggtgttttctttgtgcctctgtgtgtagcatgtctttttatctccgatcacttttgagattttctctcactaactttcagtaatttgattattaaatccttatgctgttttcttcatggtttttgttgtttggggggtgtttttatttgtttttgtgcttggggttcattgagaatcttggatttataaatttatagtgtaggggagaaaaaataatttttcttctacccttctgagttctcagctgggacttttataacaagacagattaacaagagaaaagcagataatcagggaaaaatgagtaactctcaaagaggtggcctagaattttggcttatgtagcatcttcaactaaaagaaagaaagaagggtgttgggaaaacaagctatgggaaagcgttcaggaaaatcaaacaagagtaaggtttattatgcagatttaaattggtgccttctccattggtaagagccttttgtgatttagtcctccttcttttcccagcccagagagggagatagccttagaaatggagatttcttttaaaaatgtaaatttcccttacagaagggtaacttctactgtgtttttagaattctcctgtgtctactgtttctcaaaataatcagctcaaaataatccttatgccaaaaagtcatattttagggtggcacatgcctgtctcctacaagttttcatcaagtttgaaaactttttggtcattctttgttcaaatattttttctatctgttaccaggaaggggtcccaatccagactgcgagagggttcttggatctcatgcaaggaagaagttggagtgagtccatagagtaaagtgaaagcaagtttatttaagaaagtaaagaaataaagaatgactactccataggcagaccagccccgagggttactggttggctatttttgtggttatttcttgattatatgctaaacaaggggtggattattattcctttccaggaaagggggggggcaattccaggaactgacagttcctcctctttttagaccatatagtgtaatttcctgacgttgccatggcacttgtaaactgtcatggtgctggtgggagtgtcttttaacatgctaatggattataattagcatataatgagcagtgaggacgatcaaaggtcactttcatcaccatcttggttttagtggcttttggccagcttctttaccatatccttttatcagcaaggtctttgtgacctgttccttgtgctgacctcctatctcatcctgtgactaagaatgccttaacctcctgggaatgcagcccagtaggtctcagccttatttcacccagcccctattcaagatggagttgctctggttcaaacgcctctgacatatccaccttcctcttttttcaaggactccaattgtaacgctaaagatttttgccttagccagaccaaagaattggtgtggcggctgcccgtggcgatggaaacacggaccaagagaaaaaaggctgtaggctttattgagcagagtgacagtacaaagcttttcagcgtggaaggggtttcgagcgggtagtcagaggtcgatgatgcagttgcttttgaaactctttaaggcgggaaatacgtgtagagggaagatgttaccagagcgagaaacaaaggcagtaaattattttgtgacatgtcttagattttgaggaaaaccagaattgtaacttaggttttatttattttatgaccttgcagcagcatggcaaaggaaacaatcttacaggactttataaagtatgtttacaaggaattggaattgggagtatagataaagttcgctggtcatagaaaaacaggcatttaatattccttttagttttaggggagggggaagggagagagggagagaggacacagggaagcttacagcaaaatttttgctgtttatagctttttttgggaagaaaacacatgcacaaatcctggtgttaggaatattttaagcatatatctttaatattattcattcaggaccgaagtaagttctgatgcagaaaatgagtgagttttacagctttctgagcccctgtttgactcaggaagcccagctggccccctcctttcaaaattacacatatattaggccacttgaagttgtcccacacctcactgatgctcttttcattttttttttaaccctctgtttcattttggattgtttctattgctctgtctttgcattcattaatcttgttttctgtggtctaatgtgctctcaatcccatccagcatactggtattcatctctagaagttggattttagtgtttttctattttccatgtcttaattgaggtaagacccttctgggttctctatcacatgccttgtgaattgtgctctccttttttgggaactggcactatttccagccctgtgtgactgttgggtactgttctagctaatgctttcaagtggttctttcctggggtagttttttcacacacgtgcacctgtgaaattaaaaaaaaaaagaagaagaaactttttatctgaggaatgtgagcccctttaaattatcaggctcagagaggcattggaatgaaactgcagtcacatcactcccccttgagtgattatcttgtaaagccacttgctatacgggctccagactaactgatgccaagcagccataaaataacatatgctggacaccacgactcatatcctatagttcaacagtgtataaccaataactaatccatgtcatctctgtaagccaatgaaaatttctatcaaagaactttgtatccatccacttcttcttacctttgcctttaaaaacctgcttgtaacaaaagctgattgagcactccctgagttaacttggaagtgtgtcctgggcagctgtgctcactttggctcaagtaaactctttaaattatatcttgtgcttcagccccttccttctagatcagcacactgattactactctgctgaatacttggtggggaccctcagcagatctctggaattctctctgtgtgcagctttttcatttccatttcttggatccatgagctctagccaccttggtctctccagactcagctctgtctcctcaattctgggactccactgggacctgcctgagttcccctgtaccacagcctggagaccctctcaatgcagtagatgaggcaattgcagggctcatcttttttcttccctatctctcaggggtgactgtcttttgttgcctgatgtccacagtttcaaaaaaacattgtttcatgtattttgttcttttgtttaattttgtttagtttaattttgtttcaggtgagaggataaatccagtctctgctactccatctgggctggaaatctggtatatcattaataatattcttgttgttaatttgggttgtgggtttataaatgttcattttcttattttgcatcattaaccatatacacatatatattacacattttttcatttgcgtaaaatattagtcaacttttttaagttctaaaagaaagtgaagagccctggggcggaacaagggcaaagaagtaggaagagtctgtggccaacctcttaactcacgtacctttctgacccctctacctcttctacctagagccctccatctcagccagctccccctgtccttgtcaccatgactctgaaggtgcctttctgacacaccaagatggtcaaggaaaaatggtgctgggttaggtgacagggaagatcatgagctttcatactttatgatctgacaagccactgtagcctctcacatttatatactaagtgagggtctttcagaatagcgcttcagtgtctgcacctgactcacactattaggcagttaaaagctggggaatgagctcatgtgaagagtttttccatttcagatcatagctatttttaggaacacaagctacataaatgttttaacccttttcccatccttttcctcttgctgctgtgatacaggaaggaaatcaaaatggagtgaccttgctatctggggaaagatgaaaactgcatatgcaaaagcaaacagactgagatttataacgagttgatcccttaaaagcttaggaaagaatctcaagggcacataggaaaataagcaaagggcttgatagacataatcatgacaacacaagaaggtgaagtcgggaagaggaaatggacaaggtcatcccaaattgaaataacttataaaagataaattataatatctccagaaattaactgtaaacattcctataaaatcatagatgataattttttaaaataaaagattgagtagtaagaataactaagaataaaaaattaatgagttcctagtggaaacttaaaattgaaccactgggggactttctataatgaatggcagttgaagaaaaaaatcgggtaaactttatatgaatatttgagaaacacctcaagcattagcaactacataaaagttatacatttcacctgtccaagagctgttacaacagtatacaaaacatattaagcaaaattgtactatagacaattacttatatgcaattctttacttaaaatttagcagatacatttgaatagtttctaaaacacatgatcatcaaagaaggaattgagtaggaaataaagcattactgttttttactcataaagagatgaaaataaaataaattattggtcaattctttatgagatttaaattatcttagcatttatttgtttgtttttgagacagggtcttgctctgtcactcaggctacagtgcagtgacacaatcacagcgcactgcagccttaacctcccagactcaagcaatcctcctgcctcagcctcccaagtagctgggaccacaggcatgaactaccatgcccagctaattctttttatttttagtagagacaggatctcactatattacccaggtcagtttcaaattcctgggctcaagcaatccacacaccttggcctcccaaagtgttgggattacaggcatgagccactgcacccagcctatctcatcttttaaaaaaaacatatcaaataattgttcataaatcattttctatagtagagagcaatttttcttaaaattggcaaataagattttgcatctacctttgagaaaattgtatttgtaaagtgattttaaaagaatgaagcctatgagtatgatggcattataaaagtatcagtggccaggtgcagtggctcatgcctgtaatcccagcactttgggaggctgaggcaggcggatcacaaggtcaagagattgagaccatcttggccaacatggtaaaaccccgtctctactagagatacaaaaattaactgggcatggtggtgtgcacctgtgatcccagctactgggcaggctgaggcaggagaattgcttgaacctgggaggtggaggttgcagtgagccaagatcgtgccactgcactccagcctgggtgacagagcgagactccatctcaaaaaaaaaaaaaagtattaatgtatggaaatacaaatgtcatatatagatgtaaattctcctaattgttcttctgagcatcatgttttttttccatgaatttttattttaagttccagggtacatgtgcgggatgtgcagtttgattacataggtaaacgtgtgccatagtgatttgctgcacagatcaacccatcacctaggtattaagcaaagcatttattagctcttctacctgacattctccctcccccaaccccacccgactggccacagtatgtgttgttcccccaccatgtgtccgtgtcttctcatcgttcagctcccacttataagtgagaacagagcatcatgattttcattgtccatcaaatgctagaagactactctgcttttgttactatgtttgccccatttttctagctcttcttacatgaatttaaacctacatcaatggctatttcctcaacatttggaaacaacaatacttattagaaagaaagtattttatccttccaggctatagatcttacattcctcttacacaacaatcctaattccctcatgttatcctgatcaatgaaatgatttcacttatttttcaaagaagtagctattttactacaaagcaggaatcgcaaggcttggggtgggcactgttatactccatcagtgagtatgtaaaggaaatcaaactgtctgattttgaatcctgcttctattttttacaaccttggacaaattactgatttcctctttcactaggtttatcatttgtaaaatggagatactagtgtctactcatggattattgtgaggcttaaataagaaaacatgtatcaagcatatttgtctggcatgtaataagcactctaaaatttatgcagcgatgaggataatgatcctagacaatctgatagcatcttatccaaaggaaaaaatgcgcatttcctttgagtaagcactactgattctaggaatgtgtcctaaggaaaaaataagtcaaatgtttaaaggtagtcacaagactattttggtagtaagcagtcttttttactggtcacacagtaaaaaattagaaataacctacatgttcatgaagagaagttggtgaaataaattatggtacatgcatacagtagaaaactttggagacaaaatagtaaaatagttacagatataggctttgaatataaattttaacaagctgaggcttctctcgtctcttcagaacaccctgagttcttcccggcctttcttccttgcttttcatttgtgtcagtcagctcttgcttgtacagcaatcttcaaatctcagtagcatataaaggtaagcatttagttctcacttacaagtttgcagggcaggtgaggcagctctgcctcaagccacaatgtctaggacagctctgtttcgcacggtggctgactagctaaaaaatgttcttgtctcagcaatcacaggagaacaagagggtgagagataatgtgtgaagcttcctaagtgctaagtttgaaattagcaccatgtcatttccattcacatttcgctggccaatgaaagtctcatgatgagccacagtcaagagtcagagacgtaccctcatgaggctgtggagagagtgtagattcagggagcggtgagaaactggggccagtacaccaatctacagcatgatttgtcatcatttttcattctctgctagtaagattgccaaagtctctctgcactcattgaattcatcctagtttccatttagctctctttctctcttaccacaatacctaaaaatctttttatggggttacaactctgtctcaggagccacctcagtttggtggcacagagctccccacttgtactctgaaactcttttcttgaagatattgttatccatgtgcatgagttatttttcttctccatagcatccacattaaacaattaattaccttggatttagccaaaataaacactccaaattcatgatgtctttcaggaagagagtttgttttcttttttaaccaaaatgggagattgatcctgtctgtgtcccctagaggagcagaggctggtttgtattagggcagctcttgtagatgagtaacttttcccatggcctcatagaggctgatatagatacttctggattcaaatgattgtttggaggcattagccaggcattgaaccaattataaagagtgaggttttgccatattctaaccgtaagaaacagaaacggtagagggtaaaaatagaatagaatgtcaacacaactttagccttttccctggattctgagagttcataacctgaaaatcagagattcaaactgggagagatgggctaacaggtatgagcatgggaaaagcatgtttcaaggatttgagatgtatttcccagaaaaggaacatgatgaaaatggtcagaaaaggcaatttccttcctcttttctaatttggctctggagccaccagcagaacctcttcaatatcttgcatgttacagatttcactgctcccaccagcttggagacaacatgtggttcttgacaactctgctcctttggggtaagttggactcagaggggacagttagaagggtacaggctgtggctgttgtgagtcaagagttttgtcttcctgtggtaactctgggtagaactcatgagtatgaagcaacttgtatctgtgcttccacggtttattagagcttattttatgaaaaggatgggaagggcaaccctgaggtagcattaagcctggacgcaccgcagtgaagtttccttgataaccacctgtagcttgttcagttctgttagtactggattttgagaaagagaaatagaaactcaagagatctgagttgatccctcagagtctacattaattctgtctccccaattctctcttcctcattattttccttggaccaactgatatctttattctctgatctcttgcagttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctcccctttactccacttgatctttttctttttcttcttgtaatctccaagtagacaccacaaaggcagtgatcactttgcagcctccatgggtcagcgtgttccaagaggaaaccgtaaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggtaattatgacttggaccaggagggccggaaactacaaggtcttcctctgcgttctctcctttctggatgccagatgtgtgtgtgtcgatttatctgggtgcaggtctcagcactacgtacctaccaggtgacactaaatcagtatactcaaaacatcacagcagggtccttaaactgtgtaccaacagtacctcagctgggccagctctaagtaggatgtctagagtaagacttcggccctaagattgtatcattattccaaatgtatgcctgtacatagtaaataataataattcaaacaaatgagcaataatgaacaatgaaatatcttcctcccacccaaaaccctagatctgcagtcaccttccacagaaacaaaactgctaatatatatatatacatattatgcatatatatgtatatattagcattattatatataaactatatatatatatatatatatatatatatatatatatatatatacacacatatatatagttttaaagctgtgggtggtagaacactttctaagtattgtcctatatcttacttttatcacttaaaataccttgaagttctgtttatattaatagaaatccactttaaaatgtctgctgcacagctgtaccagaattaatttaaccattctgcctattagcaaatttataagatgtttccactcttttgattttacaagcattgctgcaataattatctttatacatacattccgggggcacatttcatagggtatctgtaagataatattctggacatggaattattgtcatattttaataagtggaagcagaaaagcccaccacccacttaaacctgtaaggagtttctattcatcaagagatggagactgcaatattcttcagggaaaaatgcttcattcaatatgcaagacaaaataaccaaatgtattatttagttattcagaagtgatgagtttaaacttctttaaaaatgataatgcaaaagttaatccacactggaggcaaaattgcctttatgcagacatggttgctgttagaggaaatgtgttttagccaaggaaatgttgagaatgtctgagggaaggcttgatgttcctcatgtgtcccttaggtctctgtaaataagttcttaggatggagaggttagggaagctgacagagctgtttccctttttttttttttttttttttttttttttttgagacagagtctcactccgttgcccaggctggaatgcagtggtgcgatcttggctcactgcaacctctgacagagctgtttcaacaagacactttgggtaattcaagcagaagtgtttcatggttcaagtgacaacaaaaggactagggctgggaagagcccattttctttacctctacacagactctaggacactcagcatcagtgacttactgagaatcatatcttttttacattacattttaatgtgaattttcattgaaatataacttatgtacaacaagccataaatgtacgccacagtaaattttttcaaagtaaacagcatccagatctattttagacatttccagcacctcagaaactccttcttgcccatttctagtccacccctgacactgacttccagcaccataggttttttgcctatttttgaacttcatataaagggctacggtatgggacaggatgtactcttttgtgtctggtttatttttctcaacattatgattgtgaacagtatacatgttgtaaattgaagttcatttgttcttattactgtatatttcatattttcccattctgctgaggggctcgggttgcttctggttttgaccacttacaaatagtaatgctgtggatatttttgtttacatgtttcaaatattttctaccattactaatgttcgacagtatctgatggaggtatgttacaatttcccactcttttggatatacaaatgcaaattaagcatttccctaatgactatgatattgaccatttttcacgtttattacctatttgggtatccttttttgtaagctctttttgataatttttctattgtctgtctttttcttactgacttataggagttatttatatattctggatataagtcctttttcaagtgtcttaaatatcttctcccactctgtggcttttcttttcactataatattaaagttttgtttgttttcaatgaacaagacttgttaattttactacagtacaatacaccaacatttttggttggtgctgtctatgccctattttaaaatgttttgccacagtcagccatggggaattcaattgcagctcactgactcttagtcatttcaatttaatcagtatatgctaagaccaagaaaatgcagctggttggtggacccgagccctaatcatatggctgacaccaaagtcatgaaggtaggggaatgattgttgagtaggaaattagtaatgtctgctaaaagctgcatctcgtgagttttgatatataatactaccattaccatttaagtttaaaactcataaatttctgttatacattattttattcatgaattacttagatgttttttggagggtagttttttgttattgatttctaatgttatagcactttggttagaatttgtgttaaacatggtatcagttcattagtatttgttgaaaattgctttgtggcctagttcacacttaatttttctaatattgcatgtgtgtttgaaaagcatatgaattttctttctaaagtagagcatccacaaaatcaagcctattaattgtgtcattcagatattttctaccattactagtgtttgacagtttctgatggagatgtgacagcatttcccactcttttggatatataaagcaaagatggcagtgtttggacagtgcagtctttcagcatctgctggctgtgggtgggaataagggagggaagagaattaattctatttggaagcattatatcagtatccatgactgtaaaattcatgctatgtatagcatagaaacacctgccttccattcttagataagttctggaggggaaaaaggcactattgtctcttttccgccttagtctcctaagaaccccatttttacttagccaaaccaactgcctctggagaaaagaaaagtagttgaagcatttttggttatgtgtagaggtgtttgtcgaaaggaaaaacccattgacttggagcttgttttgctagtgatatcattgatcttacatatgtgagtattcatatcaatgtagtaggatgtttatatctggatgtttgcccttctgtgtgtttgtctcaggatgcgtggtcctattaacaaatttgtcaagagttggagtgtatttgttttctattgctgtgtaacaaatttagcaacaacatacatttaagatcttccagtttccatgggtcaggactcccatcacagcttagctgagtgctctgctgagagtcttccaaggctgcagttagggtgttgactttgctgtgtttctgtttgcagctcttccaggctcacaaggtcactggcagaattcagttctttgtggttgtaggactgaggttcctgctttcttgctgcccatcagtggggggccactctcagctcctagaggcccttgccttgtggcactcttgtaggccctctcctggcgtggcagcttacctcttcaagttcaggaggagactttccatccagactgctaagatagagtcttacataatgtagcaatcccaagagtgacatttcatcacccttgtcatattctgttggctagaagcaagtcataggttccacccacactcaaggggattatgcaagggagtgagtcattgggatcattttagaattctgcctaccatgctgtatgaactgtttttgtttcaaccaacttctgagatctggaaagggaagataagaaagggctgtgtacgcagttgccagtaaagattgcttttctttccaccaaagctaaagatatttgaggaactggatataggcctgagatttagcagagctctgaggctggatgttgcaaggagaaaaaataggaagcccacagggccaagcttgggcctccttgtacctcctccactgtatacatacattttgggttcatatttttcaggctggccactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcaagggaaagcatcactacacatcagcaggaatatcacaatacactgtgaaaggtattgtattggaatagtcatagaactgatagtccctccccctgagggaccatcataaatattctaaactcctcactttaatttacaagtgaagaaaccgggctccagagaggtaaactgcattactaaaggccacaccatgaccagtagctggaaccagaactgaggtctctgggtcctagtccaatactctttccagtgtaccgcaagccccatcaataatcacaggagctaatgtcaatgtcagggcataatggtgatccatttcatccatcattattttagttgtaaagaatacagactcactctaggtagataggagagttagaaaataataccatggaatctcatggaagccccatagaaagagaaacctggaaaatatgaggaacgggctatactgtccatctacctctcagggacaaagcagcctctgtggtgccacttcttcctgagcatctgcaggctaagcagtttgcatatggccttgttctgaccctttcacggcctttcctcttaatacaatcactagcaacctttctctgtctgagaaaaaaaaaagttcactcctgtgggaaagaaattattgtcccagattatcttttaaagtcaggaacaaaaataatgagtcactgaaatgtggcgggcacctgtagtcccagctactcgggaggctgaggcagaatagcatgaacccgggaagcggagcttgcagtgagccgagatagcgccactgcactccagcctgggcaacagagcgagactacgtctcaaataataataataataatgataataaagtcactgaaatggcaagtgtgtgagtcagggttcactcctagttgaccactgccaaaagggcatggttattgaccagatgacatggtcattcagggaaggatggaccatgtagggcaggggttcccaacccttactggtccgtggcctgttaggaactgggctgcacagcaggaggtgagcttcttcatgagccagcattacggcctgagctcctcctcctgtccaatcagtggcgacattagattctcatagaaacatgaatcctattgtgaattgtgcgtgcctgatgatctgaggtggaacagttaccttccaaaaccgtccccacttcaccccccggctgtggaaaagttgccttccacaaaatccatccctagtgccaaaaaggttggggaccactggtatagaggtatcctcagtaggactcagcaagctggcaaccctaattatgtctattaggacaccccaagaatggctctctgctggaagtaaaaacggttaatgccttatggattcattttctaaggccaggtttcccaagggggtaaagggcatgtcttttgtgaaaaggacctggatgctaaacaggcaaccctttcccccatcaactttctccttagagctatttccagctccagtgctgaatgcatctgtgacatccccactcctggggggaatctggtcaccctgagctgtgaaacaaagttgctcttgcagaggcctggtttgcagctttacttctccttctacatgggcagcaagaccctgcgaggcaggaacacatcctctgaatactaaatactaactgctagaagagaagactctgggttatactggtgcgaggctgccacagaggatggaaatgtccttaagcgcagccctgagttggagcttcaagtgcttggtgagtgagaatgacgggaagccactggcacagaagaagggactcccttatctcccatgggactgaggtttgttcaagggtttttggcccagacaggaggggaaagtctcttcaggaaaagcccacaagcaggcctttccatccttgattcacaacatcactcttctcctcgcaaactgttaaatttcctttcctttctttttctttttcctttgcctttccttcctccatttctttccttcattttctcctctgtccttcttttcttctccttcattttattttcccctccctcccactcttccctccactccatgacccccgcttctctctctctctctccctgcttccctgcctccctcctcctcaccaacaatctcaccaacaatttatcaagttcttcctatctgttgtcatacgtctggggatataaagacatttgagtatagttcttgcttcaaggagctcacaaggtggatttatcagacagtgattttgtaaactgcaaatcaccacctccccaagtatctctatttaactgaggcagagggattgtgagctccagaacaaagtctccttgggggggaaaaaagttcatcttcaacccaaattcatttcaagtattaaatggcacagagatatcagttgtctctggaactaggaagtaagtccactgacagggcccagcaattaagctcttccaaggagcctgtccctgtctatacaccatatagccagttagagctaccgccagttccttcctgctccctgaaatgaccagtgcctccctgaggacaggcacatcaggtctcagccaaccttcccttccaaacataactcagccagacccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgtccacttgctccccgtgagcactgcgtacaaacatccaaaagttcaacaacaccagtctaaccagaactgtgtgtctcatggtatataactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagtcaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctttttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacagctgaggtaaaaactgaactatgtaaatgactctactaaaagtttagggaaaaaaaacaggaggagtatgacacacacagcaacttgattctagattatttggtttgatccgtaaatgatgggatggggcgtcgcgctccgagcgtgtcccacggcgggcccctggcaccacactgtggccgcatgtgcatattgcagcctccgcccgtatctgggggccgcagccgccagcgcccggggacccagctgcggcgaaagctgtcgggcgcgcgcttcgccgcagctccgcgcccccgccaaaacccagtgagaaattatttgcattcctggagcctgcaggagcgagaaatgagctgtaggagtcggtgggcagcaacggcggcaggcggatggaagagagcaaggggtcgccgttcgtgtcccattcgcccgagtcaaggggcggccccccaaaatcccaacgtcattgtttcctcggggccggcaggtgtgaaaacccggcggcagaatggaagttcggtagtctgcgagggcccgcggcctccccaggcgcgtagctgagtccctccaaccccgccccgggcccgcctgctcccgggccccggcgcggcgccacctggcggccgtctgtggaggttgcagctgccgccaagccacggggatgctgccggcctcaggtgcccccggccgagcctccgcggagaggaggactggtagatcacaggaaacgggaggacggcgctgggctcccagcaggcgccccagcttcttggcttgtcgcaagagcagccggaggcggcggcggcagggagggagcgggtggggagtgggagaggccgcccgcctccccgtccagctcggaggacctcccagctggttccctcaccgtcaaaagcaggaagggagctggctcggcgggatcagcaagccagcgggcaagaaggctccaggctccgcaggggccaccccacatggactcgggaaccgccgagcttcacccacaagggcccacggcccatcctatcacggatgaaaagattacaggactgacaatgagcccctggagggatctgatgcagctggcggggagaaaggtgggtcggacttagaggggtggtggggtggaggaatatctttcttctccctgggacctaccgaggcttcacctgtgagggtcttgggcccatccttcaatccgagagcttccaagccaaagcacagctccccagagtggacaagtggagcagaaccggcattaggttgggagggtgggtcgttagggttagttcttcaccttccaggctgggtatggagacctctaaattcatcctagggccacaagagcttctgtaagagttcaggcccgtttcagaacactcagaggttcctagcctgagaagtaatccccaaagcagaccaaccggtttggggtaaaacaggaatagttgggtccattctggatctttcctagctaaatgccttcaggatttaggaacattttcctaggagggccaaggattagctagacctgcccagcgattccagccctgagaaccagacagaatggaggtatagctgacagctggctgggagggggctgacggtcctcactgccaccaggcttagttggagacagattccccgggctgtagagagacaacagtagaagcaaagagaccagttaggagtctaggtgagaggcagcggcagcctggactaacatggtaacagtggagctattgagagtggtcacatttggaagatgttttgtaggaagtgtcaacaaagtttcttattgattagatgtagggaatgtgagaaagagaaggggggggaacacgtagattttgggtcaaagcaataaatattccattgacagaattgaaacagcaagttggtggaggaggggaacggggtagcaagaagcgaatgtttcatattggacattttaagattcctatttgacatttaagtgtaactcttgaaaaagcaatggatatatgaagaatcctagactagagatacaaatttgccaatcatcatatagatgtggtatttagagtcaggggactagaaagaacaatgtaagggggaagtacagatagaaaaaggtctaaggctgagccatgaaatatgccacattttagaggttgcgtagaagaggtggtagcaaaggatattgataaggagtaccagtgaggtaggagggaaaacagagaataaaacgtctcaagaaagagagatcaactatgtcaaattctcctgagaaaactattggatttggagtgggaatgcactaaatctgtcgatctttttggggcaggggcgggagggagagggttagggaggattgatatcattccaacactgactttccaatccataaacaaggtataactctcatttatttatgtcactgttaatgtctcacaacaatattataatattctctctagatgtgttagatgtattcttaggtccttcatttttgtgttattgtaaatggtattgtcagaatcttcagaagtaattattggccaggtgcggtggttcatgtctgtaatcctagcactttgggaggccaaggtaggcagacacttgagccaggtgttggagaccagcctgggcaacatggcaaacctcatctttataaaaaatacaaaaattagccagtggcacacgcctgtagccccagctactcaggaggctgaagtaggaggatcaattgagcccaggaggcagaggctgcagtaagccaagatcgcaccactgcacttcagcctgggtggcagagggaaaccctgtctcaaaaataaataaataaataaataaataaataaataaataaataaatgaatgaatgattattaccagtctcacagctgaggcagaaatttaaaacaaataaataataagtactgcatttattcactccaagaaaagtaaaagctaaggcccagaatgtggcaaggcaagggttaaaaagaagagaacaagttttcctctgcctagcaagcttacttcaaggacagttataagataacgctgtccaaatagccaaggtcaaaggaataggctccagacacccctcccttccagagcaaggttggaggaagaaaaagagaaagattcttttactcttactctttccccaggcctcttaagcattatttacaaatgtctgtatttagccagtttttgtttttctttcgatgcaactacaaggtcaccagctatgcaaggtcacaagttatgttatgctatagattatgtgacctgtcactgtatgattaactgcttttgttttgtgtctgtaaggccgcttataaaaaccccactctgtctttgttcagtgctcagctttttagatgcaaacctgctgagccgtgtgtacctaaaataaacaacaatcctcctgtttttccatattggcctctcctttcctcagtttaccacaacatagccataatagtataaaaactgaaagaccctaagacacatatacattaagcttggcaacggaaagcaggatgtcacacacacacaaagctagtaatgtgaaaatctggtcttgcataaggtcttttaggtacagacttctttgttaatgcacattggcaggaaaatgggaacgaataaaattgcttgctgtccttctccctttattctccacttcttgttttttctaaatgtggggtcaaaacttccatgagggtaagaagttcagttttctgcctttccccttcatctccctatcacacatgtatactactccttaacacttagagaagataaaaaaagaataaattgtggagagggagcatatgtgaaagtaaaagattcccagacataatacgggagttaatggagaaagaaaatctctaaggaagactagaaataattgggttagggattctcgagaagtaaattaaattccccaaatatggtattctctgagaagataattttgaagaagcaatggcgtgatatccagtgaaacagcagtcctctggagcctggctgtgacttcaaggcccagttcttctggaagggcagaaaaatactttgaagaggagaaatgggcatttatataggtttataagtaccatctttattttagaaaataatcattttctacctggaattctagtttattgtgaccaaagattgtaaaatttcaggatatggctgaattaaaatcttggtcctgcacttaaatagctccttgaattgcaatttcttatcccaattattttatcctttcattccactgtgaaatctatatcatggcacttaatagtcaactttattattttaatttaacaaatgcttatttacctttcatgggttatttcatttagccttcataatatctcttgtcattgcctcacactcagtcggtggcttttaatactattctattattttgatcaatttgtataatatattctctcctcagtgtttggtaaagctgtctgggcttgcttttgtttgttttttgagacagagtttcgttgtgtcacccaggctggagtgcggtggcatgatctcagctaactgcaacctccacctcccaggttcaagtgattctcctgcctcagcctcccaagtagctggaatcataggcacacgccaccacacccggctaatttttgtatttttagtagagacaaggtttcaccatcttggctaggctggtctcaaactcttgacttcaaataattcacccacctcgccctcccaaagtgctgggattacaggcatgagctgccgcacccggccttggtgctatttttaaggatatgtatatctgatttttttttctgtttctcttatagttaattctttagtcaggtattttacttttcttagctcaactttggtaatttgtatggaaaagtcaacattttgtctacatttgcaaatatatatcaaaaatacacatcattttaatatcttctatatctagtattacttatgtgctttttcaatagtaagtttacggaaggattaactcttaattttcttttcagggaacacagtgtttggttttataaattccattttggtggaataggaaggtatgatctgtttcattgactatgctttcatcttactttatgccttctactttccacaggtttttgttgtgttcctttgttagcgttggagttaaaagcttaattctctctctgttgctcaggctggagtgcagtggcatgatctcaactcactgtaaccctccacctcccaggctcaacgatcctcctgcctcggcctccctagcagctggaactataggcgtgcaccacgatatccagctaatttttgtatttgttggagacacagggtcctgccatattgtccaggctggtctccaattccagaggcaataattgggaggccaagacgatctgcctaccaattattttctcttaaatgcattttaaagctacaaattttctcctgactgcttcatgtaggttttaatattatttgccatgaaatatatttcacagtggaatgacagataattgggataagaaatggcaattcaaggagttatttaaatatagggctaagatttgaattctagcttactgggaccaaagcttgtgaagtctcagggtatggctgaattatagtgctcttgttatttctaaagagcgtataatttttattctgatatcccctttaacccatgtgctttttcctaagagtacaacttaaggagggcatgtttgattattttattgttttataatcagttaactatgccctggtcctatatggtttcagcttttcagcacttgttgaggcttaatttgccatctcacttatggccaatttttgtcaatattctatgtgaatttgaaaataatgtaactttcctattttgaatataagatggtataggcataattatagttatgattaatcttattaaccgtgttcttcaaattctccatatcctcaataagtttcagtcaactagatctgtcaattcctaagaaaggtatattaaacttatcactgtgattgttgacttatatgcacatatgtgtatgtatccttgttaaatgcaaacaattcatggtcattccttaatggagcactacctttatgaatatgatatacccttctagtgccatatataaatgtatttttaaaccgacttaaaaaaaaaaaaaaaagaggaacttgctctgtcaccaggccagagtgcaaaggtgcaatcatagctcactgcagcctcgacctcccaggctcaagcaatcctcctgcttcagcctcctaagtaactgggactacaggtgcatgtaaccatgcctggctaatatttttactttttgtagagacaagggtcttgctttgttgcccaggctgatctcgaactcttggcttcaagtgatcctcctgcctcagcttcccaaagtgccaggattacatgtgtgacccaccatgtaagcccacatttttctaacttctacagtaataatatctatatcctatttatttataacataaatcttacttagcttgttttacttctcttcactcttgctttccctaccacccttctacatcacctggaatttgaattccaggttttctttttaattttctagaatctaaattcactttgtttagcaatatcttttaccaaatacatgaccacctttgcttccattatctcacatcttcccttatgatctttttaaaattattgctggaatagaattctgaaaagtcacccacacttaaatgatagtttaattgaattcaaaattattttccctagattttaaaaaataatgcttcgtgtcttcttatatccagtggagcccaaatgagttggatgtaaatttgacttccatttcttcataagcattttccctgaatatgtttagaaatttctccttgttcccaaattttgtcactgtgaatctaggtgagggtccttctcatcctgtatgctcagaatttaataggaccttgcaatctaaggatgtatgtatgcatttagatcctgtgaaatatcctccttttattcctttattttctcatgactatggttgcatactacacaatagtaggttgtacactacacattggcaaatcttactattcaaatgacagcccctgaaattgtgcagtgcacaatcagcaaatcttatttggtagatctgtattttatttcttacttgttctcaattctcccctcctctctaactcctcatcctgttacatgagtttggaacatctggatctatttttcatatcatttaacttttctttcatctctgcatgcatctttttatatggctttgtggaggaatttctggcttatcttgatcatcatgaggagggagaaactcaaactatgtgtttcctgtgctttcacactacaacaatcaacacagaagactgacggcggagcggggttctccacacagcaagcaagcaatcagttctgcagtggacaccagctgagtgtactccaattcagtttttacactatttatcaggagatcccacaggttgaggactgagtctaccagactgcccccacttcaaatgccagttccaagtctgggcctccagaacttctgaccaaccatttccaagctggggttcccatggcttcctcctttgcattgtattaatttgctagagcagttcatgaaactcagagaaacacttgggtttactggtttataacaaaaaatacagatgaaaagatgcataaggcaaagtatgggggaaggagcatggagcttccatgcacctccactgggtgcgccacccttcaggaacctctacatgttcagctatccagaagctctccaagccctgtccttttgggtcgttatggaggctccattgcaaaggaatcactgattaaaccattggccattggtgatcggcttaaccttcagcccctctcccctccccggaagttggaggtgggctgaaagtcccaactctctaatcctccccttgttctttctggtcaccagcccccatcctgaagctacctaggggctgccagacatcagtcaactcattaataaacaaaacgacatcacactttggtgtttctaaggattttaggagttgtatgtcaggaaatggggttgaagaccaaatatatatttcataatagcacaatctttcagcttatttattttctcttggctttatctatcctgttctggatttatcccttgttgaatttttatgtcaataatcaaattttaaatttccaagatgtgggagcgcccagttacttggcacattttcctgcctccttgaaccaaatgaccgcactcactgctggggtcaaagatgtcagtcaccagccagacatggtggttcacacctgtaaacccagaactttgggaggccaaggtcggtggatcccttgagcccaggagtttgagactagcctgggcaaaatggtgaaaccccatctctacaaaaaatacaaaaattagctggttgtggtggtacctgcctgtggtcctgactactggggaggctgaggtgggaggagagcttgagcccaggaggttggggctgcagtgagttgagatcgtgccactgcactccagcatgggtacctgaactgtcatcctatcagttgccccaagaccaacttttgtctcctggttccaaaacatgtggatcattttttggtccactcctgtcttctgcagaagtcctccttggcactcttcactgttaccccatctgccatctttgtcaattttttatcatttctaggaatttggggtggaatatgagaagaaagcaacatatcttcaggacacaatcttgaatcagtagctatttttcacctgtgcattagagacgggaaacttgcagagcacttaacaggacttccctacgatcaccaactagtatttattgaattgtttattagtaggaaacattaagcaattatccttcataaaaacattatgaagtaagtaagcattactatagtcccagttttaagatgagaaaacacagattaaaaacatcctaaagagcagagccaagttacactccaggtggtccgtctcagaagcctgaactctttactaatacactatacgatggcatatccgggtgattttgggaacacattatacttctaccctgccaggagggccaaatgtatttactttgtcatctctgtgctgtaaggggccacatttctacccatcaactcaatctacattactcaagcatgcttgtaattcatatgttatttcctcatgccaggaagaacagtcacagttctgtttcactatgcttttatctttgagactcaaattcccccctccccactataaattatttgcacatactagtctagaaaaatttaatatgccactttcccccacaaacacatctccacaatcataaacatcatgaaataaacttctcttagacaaatgaaaaagtttcttacctttttctccaggctaaggatcaaaattcaagttttacttggttaactctcctgctaatctgaaaactgtcttcttctctatagatgcttgctgtttcaggggggcaggcgggagttatttaagaataatttccattacctaataccttgatactaatgtgaaaaaaattatgaaaatcagaggtcaacacttaaaaagatccacgaaaaatctcctacaaagacacttaaataagtaaaatcatcaaattttcataatgtaacagggagaagattgaagaaaccaaaaaaagcaagtatgttcctttgctggaactaattctatggctaatatatatacaagttaatcagcatacctttctcctgctcattattctacatataatatgggtcttaagtaagtaaacattccaaactagatgaaatacagttccagagagaaattataagtagtttaagacttaaccctttgtattagtcagagttctccagagggacaaaactaataggggagacatatatctatagatatagatagatgataatagattagatatagatatattaaaaggagtttattaaggagaattggctcacatgattacaaggcaaagtcctacagtgggccgtctgcaagctgaggaagaaagaagccagtagtggttcagtctgagtccaaaagcctcaagagtaggaaagcccatagtgcagccttcagtctgtggcctaaggcccaaaagccccaggcaagccactggtgttaagtccaagagtccaaaggccaaagaacctggagtctgatgtccaaaggcaggaggaatggatggaggcatccagcacaggagagggatgaaagccagaactctgcaagccagcttagcccgcccaccttctctctcctgttttgttgtagctaccctggcagccgactggatggtgtcaacccccattgagggtgagtcttcctctcctagtccactgactcaaatgttaatctcctctggcaacaccctcacagacacacccagaaacaatacttagctatctaggcatcctttaatcctatcaagttgacacctaatattaaccatcacaccttaggatttagaattttcttaagaacactgaatgacccttgcccaggatcgtatctgtgctgtgtctgaagtcttagactccctcctggcctaaagaattttccttcaatgcaatgaaaaatgataatcccacaaactagaaaccaagacttgtgcaaaatcaaaacattgcaaaggtgggtgtggggaaatcaagctattatctttaggtatattctattcctaggtgtttaaaacactaatattaaaaagtgatatggagcttcacctaccctctggcaatttgcagttattgtcctttgatcatgtaaagcaactgagatcatttgctcctgacttcacttcactaatctatatccttcattttttgctccaagtgttccttcttctgagtgcctagtgctgctccagtacctagatatctctctctccccctctctttctgtctcaatatccaatcaatcccaagctgtattacctctttaccaactttgggaaagtggaccagtatccaggcttggataagccaaggaaaaatactaaggaactgcttaaagctctagtagttcttctactttgctgtttctggctttggccatctaaagcaaagttccttggattggttgacagtgagatagtctctagattcttgtgtctctttttagtagggccacctaagatgtatcatccattgtgtaatgagttcttgaccaaagaaaagaaatcttaaggtcttccgactctgtcatctttcttgtttgccactctttggactgtaatttgaagagaaaaaaccttgttttcttgtgaaaattttggatgctgagtagttgacaacaacagtaacttcagctagaaaatgctggaaacaatttaatacgcagaaatgattaactccgaaatcatcaacatgactccaccagccccatttttaaatttctatttaaacatttcccaaattatttgcacattcttcttttggctgtaagtcttgtttttctctatgctagctaatagttttctagataatttctattcccttgacttgttcttatgttaaatcctcaaaattaagagctttcaactcaaaaatcagaaataggaaagaagtgtttaatgaaatgatttcacttttttctgaaagtattgacatgaagtattaaaagcatcatctgatagaaaaagaaggtacttgccaaatgttatatcggcctttatagagcactagtaacagacactataaagtcttttgtttcctaatttattattttcctaatgggccacatagcagacactgaaggttctacgtaacaaaggtcctacaagtaaattgtgaaaatcccttattggatggtgtttttagaatacagaaggtcctatttccttaatgcaagatgcttagggaagtcactctcaagtcactagaaatctattaaagcaccacttgctggaaaatggaatgtgctctggaagtacaatggtgctcttgctagcgccttcctaaccataacaataataagaacactgatcaaatatttaccatgttccagccactgtactaagtgctttgggtacattacctcatttaatcttcatatcaagcctagaaggtagtttccattattttttccaccttacaggggaataacttgaggatcaatttgctgtaaggaagtttatttatcacaacaagtaaagaaagttttccaaggtcatacagtccttacgtggggaagctatactcaaagctgatgttcatcgccactacaggctagtgccttctcagcaagaactactcttacagtgctaagaggagaaatgggcaaggtggtaagagccagaatatctgttgttgatattacagatacagctctgaacttaagaccctaaaaatgatctccaacctcagttgcctctgagagacttcagcatgatatgtgatcatgtgagagccacgttatgtgtattctttttaccacctcttctgtattcatctggagatagttctcttttctgttttttctagaggaaaaaaacaacgacaaaaaaacagggagatcttagcagaaccaaagcagattagatattagccttgaaaatggtgacagcaatcagtgatattgaacctgaaataatttaaataattatcggggacttaccagagctaagttcgtggaccactgggatttctcttatttgggtctcatagtcttccataaagtgatgggactataattgtccatcttcaagtatccttctatgactcatgtataatcccttgactcttttaggagattcctggcagttaatgtcaatactgtccttcataatgcttctgagttagcttaggtaaggtccttaaatacccaatgacttatactctgaggcttctaaactggtatgtggaactcggtggttgcaacttcacccaaatcctcattctgtgttgtgctgtccctaatttagagggcaaaagatttcaaactcaatcatttcttgttaaattcaactcttggagctccacctgtcataaacacaatcgcatttcccatgtactcaattacttctgtttctcgaatccatcattcatcccatagatattgagtgcctaatgtattccagatatagttctacataataaggatagagcagtgtatgaaacaaagcacctaccttcataggacttattctgaggaggtaggaggggagacaaatgatataataacttagactatatctgagtaatacaacaaataagtctttaaaaacagtggcttgaataagatacaagtttatttatctttcatgtaacagtccagggctaacagagcagttctgccatcctcatcacagggcttctgcctctgggtccaaagtagttgccccaattcctgccatcacatctgcaccccagccagtggagagggtaagagggcaagggtaacacatacatattcttttttagggcacaaactagaaataatacatgcaacttccattcacatctcattggccccaaactttggacaaacccagatgcaagagaagctggtaaattagcctttaattgagaagccaagcgcccagaaagcagggagttagagtatacaaggaaagatcatttttatggatatcagtctcattcagaaataaacaaataaataaatacattagtattcagatggtatatggagaaaaattaagaaaattatgagaggccgggcgcactggctcacacctataatcccagcactttgggaggccgaggtgggtggatcacaaggtcaggagatcgagaccatcctaacacagtgaaaccccatctctactaaaaatacaaaaaattagctgggtgtggtggcacttgcctgtagtcccagctactcgggaggctgaggcaggagaatcgcttgaacccgggaggtggaggttgcagtgagccgagattgcaccactgcactccagcctggacaacagagcgagacgcgagactccatcccccccccaaaaaaaaagttacgagataaggaataccaagaagtgaggaaaggaaaggaggggagcttgttatcttacctaagatgttcagggaagacctcaatgacagttggtaaagtaacttctgagcaaaagcttacaagaaattaggaagccagtcatgcaaatatctagggatgagcctttgagaaaaggaaatagcaagtgaaaacatcctgagatagaagggccttgatgtattcaaggaagtacaaggagaaaattatgatgaaatggagcaaaacaggtaagagagagggtcagagaagtgaatgtgggccttgatgctgaagccattggagggttttctgttgaggaggagtatgggaatgatatgatctgacttatgtttcaaaaagtgtactctagctgctttgtgggaaatataggagggagagagcagaatcaaggaggccatttaaaatgccattgcaaatatccaagagaggtggaagcttggagcagggaaacagtggtggaggtggtgagatgtggttggatgctggacatattttgagccaagaggattttctgataaattgcatttggaaaataagaaaaagcttattcactcaccactctaacagtcacaccagtctataatcccagcactttgggaagccaaggcaggtggatcaattgaatccaggagttcaagaccaacctgagcaacatagtgagaccccatctctacaaaaaaaaaaactctaaaaattagccaagcatgtggcatgcacctgtagtcccagctactcaggaggctgaggtgggatgatcacttgagcctgggaggtcaaggctgtaatgaactgtaatcatgccactgcactccagactgggtgacagagcaagaccctgtctgggaaaagaaaaaggcatggcggggggtgggggggcgggtgtggtgtttcacacctgtaatcccagcactttgggaggccgaggcaggcagatcacctgaggttgggagttcgagaccagcctggccaacatggtgtaaccccatttctacaaaaatacaaaattagctgggcatgatggctggcatctgtaatcccagctactcggggggctgaggcaggagaatcgcttgaacccgagaggcaaaggatgcagtgagccgagattgtgccactgcactccagcctaggtgacagagcaagactccatcttgaaagaaagaaaaagaaagaaagagagagagagaaagagagaaaagaaagaataatcacaccccaagaacatcaagctaggaccatggtgaacaatgctccaagagtgttctgatgctgtaaactgagtgtgatgtgcataaattgttttgcactctgcaggtaggagggtgggatagccaaagctgttcaatataataatattaaaaaataaaatatcaattgaagtaaaatacaaattttcttaagcaatattttaaagtaaatggaaatgttacaacctggatgaggggtgaggaattaataacctctaatcacagaataaaaatggaatgagaattccatctacccaaatcagacaattaaaaagtcgaaagaggttacagtaaaaattgggtaaaactaaaacttaaaaaataatttcagaggatacatgatatactcgtcacacagaaaactccagttgaaccttatggacttgaggaatggatacctttgtttctccatcacttagcacagtagctggcaccatgtaagttctcacagaattttcctgaactctccaaccagaggcaacctttcactctccattcacataacatttccttctttctcttcttttgggaataatgtatcttgcttgaattatatttatctttatgccagtttaattctctcttttagattcatttacatctttgtatcctctagctcattattttttcaaaataaaatggattaacataaacaattattaaagagataaactaaaggaaaatattacaacctggctgaggggcaaaaattatatgttcaacatatatttgataacacatactgagaaaacacggtctacttttacttttcagaagtttgttcatgttgacattgtggggcctagaagatttttatcaagttttctatttttgccaagtcatatgatctgctatagttcagctatagttaaccaaatgtagaaaagaaaaaaattttccataatatctagtaattctccaaaacaagcttgttccttgttataaacactgacattctttgataactctcactttatcccacagaggtcatgtacttatttcccatctgttgtcctatgcttacattccaaattcagttgcattgacttttagaacagctttaggaactgcacccagttttaaaatacattatttgtctaaaaattatgacatgagattaaactgtcatctttgtaggtttctacacatactccaactcattcaccaatccttgaaaagattatgtaaccaatctcaatgccctgacccaggccaagcccatttctacatgtgcagtgttctctggatctgatatttaaagccccttatcctgatactacacaccttttgtcttctggaatgcacctctcttctcatcctttttcaaggcactagaaaagcagaccatttctgcagcacctcaaaccagggtgagaaagctccactctaatctcatcattttagctacatagatacatcggctcaagggaagatgccaagtgtagtactttaccactctgaggatttttgaatctataacagttgtttcaactgggccaataattatgaagggcaataattaaaaagagtatccatagtaaaggagtaagaaaaaaagttagaaaaaaagtagagaaaaatatttactagagtatttactagaacccaccactctcagatcaattttctagtgttctgttgactggcaaccagtcaacaaactttcattgagaagctattttatagtaggcattgggatagcctttgtggaataaataccgagaagcatatgtctctagcagaagacagacaagaaaatgtaaaaacaagaaaaagaaattgaggaataagcctacagtttacaaagctacacaattattcgttatgcaaggaatgaggacttaagagaaagacttccctgtgaactacaatgagatgaaaaagcttctcagagtgagatttgagcaagagtttaaaagaactgacagactgataaaaagcttcaagtagtccagaggactgagtactaaaactcagaacaatgtaacaaaagcacagaagacaaagttaagatgctttacatgacagtagaacatttaggctaagctggaggactggggagaacaagtgaagaaggtaagttttggctagataataggtggcctttagtgtcaggatgaggatttggaagttaatcttttggtcagtgggtaataaatgatggcatttgtgtagttgagccagttgacaatgctttaacaacttcaaaaggccctgaaaaacatggtccctaatccttaagaaaaaaggaactcctgacttcaggaccctaagctaggaggagattggaaaaattctcttatggcccaactgtatagaaaatagaccacctcggccgtctcacttactgagtaacctttcctaccagagaatgtgctatatatgatttctttactttcaacggaaattttggattctcagttatctttccctgacctcttgtctggtgatcagaaaaagatgactaaactgggaatctttattttctagtggaaaaataatcacgtataccacattttatatcttttaattgggtgtaaatttgaacttcaacatcataaaaattagtaaaattcattttaagcacaaagttgttaattcccccaagatttatcaagaatggcttaatttcaaaggctgtcaagttaattataagctaagattttccagttgcaccaagggtatattttatttggcaaaagaaacatccactggcttttgtcaggatgagtcttgagttattcaagttttgaactgagaggtcttcagaaattcaccccacatattaactgtggccttctctacaccacaaattcccctccactcatcctcaaattgtttcctttctcagaacatctgtgacacaaagactgtgacacacccacaggtcgattaacatgaggacccaacacctattaaaacatccacactcctgagaacactaaaaaccaaccacctcgtcaggtcccacctccagtctcgctgaatcaggaaacctcaagagaagcacctggaagcaggtttaacaagcgcaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcggacgcctgtagtcccagctacttgggaggctgaggcaggagaatggcgtgaacccgggaggcggagcttgcagtgagccgagatcccgccagtgcactccggcctgggcgacagagcgagactccgtctcaaaaaaaaaaaaaaaaacaagcgcaaaggtgactcttataattgggaaagtttggaaccaagacagggttcttgtcctggaggaagtattttcctgtggagaaggacctgtaaacagcctatgaagtgctcagctttcaccaagaaaaacatgggctgatagggttaaggaaaagtttgactgaagaggattaaatcctgaaggttagggatgtctttgggcgctggggtctctcaatcaccaaagatagacattacaggccaggtagctctttgtccccccagaggactgtcctgtgccttatgcttagcactcctggcctctgcccattggatacttctagcacctcccccccaacacacacacacctgacaacccaaaacatctacagatattgccaaatactccacagggggtggggtggtggcaatatatctccctgtttgaagtcactggaatggaagttaggggaggatggctaagtcaggacttgaaaaaaggctaagggacgaaagcacatggctatattagacaaagtttgtgacagacgcctgtaggtatatggtaaggaaaacagattaaaacactaagaaatagtaagaggttggaccgagggtttctcatctgtatgggaaatctcatctcgttcattactttcagaaacaaaaaggaaaacgactttaaagatacaggttaaaggctgaaggggtgtagaaccaccccccgcctccttccctccatccctcccaaatatcccagaacgagtcaaacctttctaatctcgtagcacagataacaagcaactcagtaagactagacggggatgactgagggccaactcattacaggactacaggaaactccttagtcctaaacccgaatgcatccgtgaccatggtaacactccctacctgaccaaaagctatcaaacgctctgacaagtgtttacagctgctttctcgattactgaagtggctctgaaaagagcctttggggttaggtggttgatctattgcgtcccttgcacactcttacttcgagctggtgtacttggtgaccgccttggtgccctcggacacggcgtgcttggccagctcgccgggcagcagcaggcgcacggccgtctggatctcgcgggacgtgatggtggagcgcttgttgtagtgcgccaggcgggacgcctctcccgcgatgcgctcgaagatgtcgttgacgaaggagttcatgatgcccatggtcttggacgagatgccggtgtcggggtggacctgcttcagcacctcctacacgtaaacggagtagctctccttgcggctgcgcttgcgcttctcgccgtccttcttctgcactttcgtaacagcctttttggagcccttcttgggagcaggagcggatttcgctggatccggcatttttgcgcgaaaaaagagaacagagacttaaagaagtaatccgaactaccgcaaaacgggctggttatgcgctacttatagagcctgtatgcaaatgaagactcgcaaagtgctgcgctttaattggttaacttacaacggtgtcgtcagagggggtggagtctatgtaaataatagattctagtcttgcttccttaatggtcactgtaacaaaagtcttgttatccaatcagaatggtccatttcacactaaccagttttaagctaggtgaagcgatagtttcaacggcttgaggtttttttcttggttttcactttccattagacttgcatacggaagaaatcttaacgccagctagacaagttaactctcttgcctcgtttttgcatttttattctatactttgtggaaatttttttctcttccttgaaatactacctcacccacacatttttaaaaatcgccagatatttactcccgcccgcttaaattactattctggcttggacaccgcctgtagtatgcaatgaggaagatgctgagctttaattaagcttatagttcctaaataaaccaggaaacgggtttataatttttaagggactcgccccacccttacactcaggatcttccacatctagaaactccccatagtctcttgcccccatgcaaaactttacccacagaattgggagccggacctctagccttaaaccagcgtgaaaaggctcggccggaaccacaaggaccgtgcctctgcggctttctctactgccggccaactcacggctgggctttgggttctgtaacgtcacccaccacgagtgcccctggcccctgaccgctgcgcaaggcagacgcacatcagatggagagccggtacagctgctcttgatgaaaacggcagtggctctgaaaagagcctttagatcgaccacttaaaaatataccttaggcccgctccccgcggatgcggctgaccaactggatgtccttgggcatgatggtcacgcgcttggcatggatggcgcacaggttcgtgtcttcgaacagccccaccaggtaggcctctctggcctcctgcagcgccatcacggccgagctctggaagcgcaggtccgtcttaaactcctgcgcgatctcgcgtaccagccgctggaagggcagcttgcggatcagcagctccgtagacttctgatagcgccggatctcccgcagagccacggtgccgggccggtagcggtgcggcttcttcaccccgcccgtggccggcgcgctcttgcgggccgctttggtagccagctgcttcctcggggccttgccgccggtcgacttgcgggcagtctgcttagtacgggccatgctgtctcattgatacgagagggtctaggcagtcgtatttatagacatagcctcctcttgattgggcctgaaaaggaaattttcaaacttgtgatctcattggttaaaattcagtcctctttactggggcggaagattgttctgctaatctttcttcccttattatttccccctttcctgatttttttctgtaattttatcgatcacggattgcttttgaagactttcctttaaattagtctaacttttgtaaaagcaatgtataaagtgttttgcatcccattttaacagagatttttttttttccccgaattcaagcatgcccttctatgagctatcagcctgtttcaggttacctgttactgaagctcttctaccatagctaacatttatttcatgtctagcattttgctcagcaagttagatgcattgtataccatgaatgaccgaagcttagcaaaaaaatatgtaattgaaggaatgaaaaaattgatcttatttacttgaccttggaacccagccaaagccatttcatgtggatagtgtgctgacctatattgacctgatattagagcctctgccttcctttagtcttttctccctgcgatgtggttccttcttcctcaccctcacatcaatggccaattaggtcctgcagatgttaagcttctaaatcaaagaaggacaacaccagaaattcatttctcctttacaatgtagaatagtttgtaaattagtgcttattagccagattacaagttaaagtttcaaagcaaattattcatcaattgctgacttgctaacattttattcaataaagtattttataatgcttaaaagtttaatatttttttctgttctctatgaagagagtaaagatgctttgctttttcaatttcatgtgctttgaagaatgtattgttcagaacagtaaatatagtggttatgtagaagcaactgatacttaaaagttgtagtagttaatataaaacttttaatcatatgcttattttactaaaaaaatcattacaaactataaaaactcaaacctgagaaaagcaggcccgaaacgcttaaaacttactttgatggtgtcattatgaactatcttcctactgaagtcaaagtaaagtaaaagtgatttcaaggggacttcctgaacactaaacacaaagtagaaatctgtgagcttaattaatatcttcaagagtctctcatgggcagaagcatcctcctctcgagagatctaaaatgtacaaaagtgtaactgatgtgaacaaatgttatccctctctgtggtagttttgtaataatgccttacagacagcaggcactactcagtgtttaaagttcttctacatacactttatcatttaatccctactctgtgaaatagatcttactcttctcactttacagataagaaaactgagtctcagagaaattatggcttgtcctgggtaagtaacaaagcctgtgtaatattctaaagcaaaagaatgaaacggtaatgatgaaactttctatttcattaggcttagaggataccttttttttttttcatttgagatggagtctcactctgtcacccaggctggagtgcagtggtaggatctctgctcactgcagcctccgcctcctgtgttcaagcaattctcctgtctcagcctcctgagcagctgggactataggcgcaagccaccacccccagctaatttatttatttatttgtatttttagtagagacagggtttcaccatattggtcaggctggtctcgaactcctgacctcaggtgatccaccctcctcggcctcccaaagtgcttgggttacaggcatgagccccacacacccagccaacacagtttaaagcacaaaagcgttttcccatcatgcaatcacatcatctagtatttctcaaacatctacacccaactattcccattagaagggaaaactaccccatggaatctggatgatagcccaaagcagcccacccaagcatcacttttctttgcaatatactttctctatgatgtatgcagtcttgaccataatgtaggatgtgttcatttaaataagaaaatggcattcaatcagactttaatggctataggtatcatttctcagaataaaacaatcagatgtatagttgccttaaaagtcatctttaataacagaattcagatcaattgttagttcaatttcacctagtccccacattggacactagagtgacatttctgtgaaaggtctcaatccaccactatatcagaagcagctttatggtgcaaaagaagctctgcttttcttcagttgtaacaaagacggaatattcctcctaaaatttttgaagtgtccttcagcagaaattataaggctgtgcagcttgaatactgagaacagaaatttcattaggtagcacgggggaatagacaagagaagattaaaatttacctaacaagaaataagcaggcaaaagaaaatattaataaatgaattattaggcacataatgttttgtatgtacatgtgtttacttttaatacaaaagtaacggactaagttaacatagatgttccaataagataatttatgtttcattttttggcttcaagtatcctcagggttataagtatcataagctgagaccggctgaattggtttgtgggttgatgaagccctatgcctgatttgaatttctcttgaatggtctgcagccctggaccaagttgaagaagccatgagagtctcagcttttttccttaccccattatgagataaactcattccttaaatatcttgctcatttgataaaacttggcacccttctcctttctactggtccctgatacttactacctgtactgtaagctcaaattttttacaatttctgcctttattatgtaacgtattccactggaatatgtgttacaggaaaggggtcccgatccagacccctagagagggttcttggatatccggcaagaaggaattcagggccagtccataaagtgaaaacaagtttactaggaaagtagaggaataaaagaatgactactccatagagagaacagccctgagggcttctggttgcccatttttatggttatttcttgattatatgttaaacaggggtgggggaggtggaccacgcctataatcccagctactccagaggctgagacaagatcatttgaacccgggaggcagaggttgcagtgagctgacatcgctccactgcactccagcctggaccacagagggagaatccgtcccccgcaccccacccccccaaaaaaaatcactgccagtaaggaacaaacagccaagacgaagaagtactaagatgtaaagagatgtaaaataggccgggcgcggtggctcacgcctgtaatcccagctctttgggaggcctaggccggcagatcacgaggtcagaagatagagacgatcctggctaacacggtgaaaccccgtctccactgaaaatatttttttaaaaaaaattagccgggcgtggtggcgggcgcctgtagtcccagctactcgggaggctgaggcaagagaatggcattaacctgggaggcggagcttcaagtgagcccaggtcgcgccactgcactccagcctgggtgacagtacgagactctgcctcaaaaagaaagaaagatgtaaaatactgtgatacattctgcaagagttatgacagagtcagaaaggggcaagcgtgtttcttctctaccctgaagcagccaagggagaagaaggtatctgttgccaacgctggggtgttacaagtgcacactgtcatgcccggctaattttttggattctagtagagacaaggtttcactgtgttgcccaggctggtctcgaactcctgagctcaggcaatccacccgcctaggcctcgcaaagtgctaggattacaggcgtgagccaccacgcccggcctatatatgcatatttttttctaacacttacatactttttcttggtgccaagaatgttttaaacactttacatgtattaactcattttatcctcacaaaaccctgtcaagtaggtagtataagtatgtccatttacagattgggagatggaggaatcacagagaggttaagaaactttctcatagtcacacagtcggtgccaaaccagatttcaactccagagtcttcctttagtcactatactacactactaatatcaaataagtaagatgttgatgcaacattgatagtaatttaaaagattagaaacaaccaagagccggggtgtagtggcccatgcttgtaattccagcatctgggagcccgaggcgggcaagtttgttgggagttggagaccagcctgacaacatggcaaaaccctgtctctacaaaaaatataaaaattagctgggcgtggtggtgcgcgcctgtagtctgagctacttgggaggctgaggtgggaggatcgcatgagcctgggagattgaggctgcagtctgcagtgagttatgatcacaccactgcactccagcctgggcaacagagaccctgtcttaaaaacaaaacaaaaccacctccgacaacgtaggaatgctgaaatgagttatgttaattctaagtaaaaactcaacctatcccaattagcccaagaccactacttagtctacctaagccaagtctgttgacttgttacaatgagggagaacacacaacagagaaactggtggcagggtggtgggaggagggtgctcaccaaacaagaggaaaattagagttatcattgattttgggggacgagtggagtgtagttttcataggctcaaagcaaagcagggctgtgtgaaagggtaggcataggatgggactttgaagtggatccagggtcttgtttcctcagaaactacaaagttgagatagaggtggaatgctgtgttcagaaaccccttacttgaagtttttgcacctgggttgaaaattactgctggttttttgtgtcaaggtggcttaggtcctccagacaggagggggatactgcattgttactgattgataggatttcaagcagccaaagttctgatagtctgtgattttgagtacaagttcctcagtgaataagaaaggagtggtcactcaaagaggggagttatgagcctttatagctgtagcatgcccttgggaaaagaatgttttctgtcatttctagtctagctttatctctgttagtgcagcctaatgaatggcagaacaggttttgattttctcagtcctagcgaatttctgcttctcgaagtgcatgttagtggtaatgtgttttatatcttactttatttcttattttccccccctttaatctatattttattttatttattttttatttttttgagacggactctcgctctgtccccagggtggagtgcagtggtgtgatctcagctcactgcaacctctgtctcccgggttcaagcgattctcctgcctcattttcctgcctcagcctcctgagtagctgggactataggcgcgcgccactacgcctggctaatttttgtatttttagtagagacgaggtttcaccatgttggccaggctggtcttgatctcctgacctcgtaatctgccggcctcggccttcccaagtgctgggattacaggcatgagacaccgcgcctggcctaatctatattttaaaaattgaactcttccatgtacccctgaacctaaaataaaagttaaaaacgaacaaacatacaaaacaacaacaacgacaaaaaaaaaaaaaaaaaaacaaaaaaccaggccgggcatcgtggctcacgcttgtaatcccagcactttggaaggccgaggcgcgcagatcacgaggtcaggagttcgagaccagcttgactaacatggtgaaaccctgtctctactaaaactacaaaaattagccgggcgtggtggcacgtgcctgtaatcccagctacccaggaggctgaggcaggagaatcccttgaaccagggaggcggaggttgcagtgagccgagatcatcccactgcactccagcctgggagacagagcgagactctgtctcaaaaaaaaaaaaaagagagaattctgtactttgtaattagaggggtaattcattaattcatgtcaggggcatattattttatttttccaaatgctaggaagcaggtatccatttttgataatataaattttgggataattggcagtcatctggctcacagggaaaacaggaaaaacaagaaacctaaataaacttcatattgatttcccaaaaaaattaccttttattttcaacccttatagaacccaacctgcatctctttgccatccatgttctttttttttagagactgggtctcattctgtcccctaggctggagtgcagtggcatgatcatagctcactgcagcctcaatctcccaggctcaagtgatcctcccacttcagcctcccaagcaattgggaccacaggcgcatgccactgtgcctggctaatattttatttttttgtagagatgaggtcaatctgcattaaacttcatgttgctccaacaccacattttatctccccactttcccagcaatggacaactaggcttgtgccaattctccatcaccaccagaaatgctgcaatgaacattgttgtatatattcccttttggacctatataagaatttcttttggataaaaactcaggaacagaactgctgagaagccagaaaccagcagttctgttcagagtttttatttatatctaattgaactaaggagtgtcagcctcccctccagaatgcttgtcccggacttccaataccaaggtagctggactctgagcccacatccaggcccaatcctcgggtcatccaactttctaagttttgccagactgcctggtgtaaagtggtatctcagcattgctttcgttttcattgttctgggtattcatgagttcaagcatctctacctgagcttgatagttttcggatttcttctcctgtgtattgcctgttcatatcctttgctccaacattgtttatagagcactccctccctactttggcatttggggtcccctaaaccggcccccattgctaaagcttacttctcatgactgacctttgcctatgctgcatgtggtccaggaacaattcttctgtctttgtttttgctgtcccctcttgcctggattacatcatcttctccaaacccccaatctaaacatgtcccgaatcctaaatattctttagaaccaagctcagatatcacctcctcctggaagggttcctttatttgctcagctggccttggcctttccctcttggctcccacaaagctcaacctgcatgtattatttatttatttatttatttatttattatttttttgagacgaagtcttgctcttgtccccgaggctggagtgcaatggcacgatcttggctcactgcaaagtccgcctcccgggttcaagtgattctcctgcctcagcctcccgagtagctgggattacaggtgcctgccaccatgccagactactttttgtatttttagtagagacggggtttcaccatgttggccagactggtctcaaactcctgacctcaggggatccgccccccttggcctcccgaagtgctgggattacaggcgtgagcgaccgcaccaggcctcaacctacatttcaagtcaccatctgtcacaggataccttccactctggctctggatatgggggtcacctcctcacaaagacagacaggttgtatgtgcatacacagaaagattcagaagaaatatgaagacttttaaaatcagtcggatgattttaactttcttctttgtagttttctctagccagttttaaaaactgtaaattgtaggccgggcgcggtcactcacacctgtaatcccagcactttgggaggcggaggcgggtggattacctgaggtcaggagttcaagaccagcctggccaatatgatgaaaccctgtctctaccaaaaaatacaaaaattggccaggggtggtgccgcatgcctgtagtcccagatactcaggaggctgatgcaggagaatcccttgaacccagaaggcagagcttgcagtgagctgagattgcgccactgcactccagcctgggcgatagagcgagactccatctcaaaaaaaaaaaaaaaaaaaaaaaaaaatccagaaaaacaaaaacaaaaaaacctcccaaaaaaccacaactataagttgtaatccatagtgcaattaatttacttggtagagatcatcttttcctttcattttgcccttttgtaagaatcataaaacgggaaaatatcaccaatagtaattatcattttgtgaaacttgttgcaatttttattttcctgtgaatgtgactgggaggcaatgtaaatgtatttcttttttcttgtttttgagacggagtctcactctgtcgcccaggctggagtgcagtggcagatcttggctcactgcaagctccacctcccgggttcacgccattctcctgcctcagcctcccgagtagctgggactacaggcgcccgccacccatgcctggctacttttttttatttttattttttgtatttttagtagagacgggttttcaccgtgttaaccaggatggtctcgatctcctgacctcgtgatctgcccgcctcggcctcccaaaatgctgggattataggcatgagccccagcgcccggccaatgtaaatgtatttcttactgtagacttgaggtcaggagagtgggctgtactgtacacatattgatattatttgtatctattccatgtatcactttctcctaaagcatcaaatctaatacaaaaaaagaaaagcaaaacacaaaacctaggctcaaattccaccttggccatgttttagccgagtaactcacgttccccggtgtctaatctttaccagaaacttccttatctttaaaatagggaaaaagccttttcttctttccagggttgttgtggactcaaacgagaggctgttagtgaaaggtttttgtgagttataaagctcctaggaacccaattatttctgctgccttggccacatagtctagaagaatctctacataattagcatctagagactggataatttacccattattttccatgtgcttgtcttatttcccagcatgatggtaatatttccaagggaaagatctaggatatatatcaagtaacgtttatcataaaaataatgaaattgctaataactattaatttattgtcatgttgagactctgctctaagtactttgtatggactgtatagcaatttatccctgcacgaatcctatgaggtatgtgtatttattgttactgttttacagatattgaaactaagacactgagcctctattttagcctcatgtcttctttccttccagcttttcccaggcaagtaaatgcaggccacagtctgccagctgcccaaccattcaggcttttcattattataggaagcatctggccaaggaccaccaacatcttcctgtcctgcccctgaagctgtgagttccccaagtggagacacagcctgttccccaacacctacactcatgaacacgggagggttggtcaaaattgcaccgctatcatgcttagttttatactcaggtgtaagtgactgatagaagggccttttggaggtggagagtgcgcaggttctgaagaggcaagaccggggaagtctggacctgcttccagagtgtcctcccacaaggcttagtgctcaggacctgtagtgggttgaatatgttccctaaagttcgtgtctatccagcatctcaaaatgtgaacgcatttggaaactggggctttgaagacgtaagtagttaaggatcttgagatgaaatcatgctggatataggatgggccttaaattcaatgactggtatctttataagagaaaggagagggaaattcggacacacagagatgagtaagaagccatgtgaagatggagggagagattggaatgaggctgccacaagccaaggaacatcagaagccaccagaagctgaaagaagcaaggaaggattctccctgagagcctttagagggagcatggtactttatttcagacttctggtctccagaactgtggaagaatacagttctgttgttttaagctaccaagtttgtggtcatttgctatggcagccctaggaaacgaacacaggttgagtatcccttatctgaaatgcttgggactgggactgtttcgggtttcagattttggaatatttgcatatatataatgagatatattggggatgggacccaagactaaacacaaaatccatctatgtttcataaataccttatacacacttacactgtgccccattttctccaacaacttgactttctgtactatagataaacataaatgttttctctcccttttttttttttttttttcttttgagacagagtcttgctctgtcgcccaggctggagtgcaatggcacaatctcgggtcactgcaacctcctggattcaagtgagtcttctgcctcagcctcccgagtagctgggactacaggcatgtgccaccacgcctggctaatttttgtatttttagtagagacggggtttcaccatgttggttaggctggtcttgaactcctgacctcaagtgatccagccgcctcggcctcccaaattgccgggatttcaggcatgagccaccgcgcctggccttgctttttctcttttaaaatcactgttactcatggggtatctgcaggcctttttgatattttcttttttttttttttttttgagacggagtctcgctctgtcacccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaacctttttgatattttcaacaatatctttataccacagagcagagaataagcaaaaaaaccccacagtgagtaaggcacgtaggtcttggctcctacatggggcattatggggaacgtgctgttgacgacactggcctgcacacatgccattttatgaccctttgtgggtgtgtgcacgttggggaaaccgggcatgtgcagaaaagatatatctcagcggaaaggggctgggagggccttttatttccttgggggaaatactgtgcattgtatgacccgttgtgtgaggtcaggtgtggaattttccaccgaggcaccacattagtgctcaaaattgttcagattttggagcctagggtttcggatcttcagattaggggtgctcaacctgtacaacatccttgcaacaatctaggtgtgagctttcctcaagagcaagaagagcttgccacttctgctatatgaccacggtgaagccagcctgtcaccctcctgccctggatgaccccagggagctctacagaggtccatggctgggggaggccagcaattgtctaggagagctcagtgccacttgcaaagacgacagatctctctacaaattctgggctgagcaggtgaaggaggctggtcaggcccatgaaggagcctagtcagccgtaaggaaaggttcactgtggggcccccgacttcccattcctgatctcctttgtacctctgctgcccacttcctttcctctttccctccaagtataccttatactctgctcctgatgacactcagatctccccccgcccccccgcccctgtcaaataaaaagagcctagtgacttttgtaagaacggtgtattcatttcctagtgttgcattaataagttaccataaacttagtggtttaaaacaacacaaatttgccgggtgtggtggctcatgcctgtaatcccagcactttgggaggccaaggcgggtggatcacctgaggtcaggagttcgagaccagcctgaccaacatggtgaaaacccgtctctactaaaaacacaaaaattagtcgggtgtggtgacgcgtgcctgtaatcccagctactcaggaagctaaggcgggagaattgcttgaacctgggaggcagaggatgcagtgagccgacatcacgccattgcactccagactgggcaacaagagcgaaactctgtctcaaaaaaaaaaaaaaaacatgaaaccaaacaaaacgaaaaaaaccacacaaatttattctcttatcattctggaggtcagaagcccaacataagttttaaggggctaaaacaaatgtctgaaggactggtttgttctggaggctccaggtatataatccactttttgactcttccagcttctagaaactggcattttttagcacctggacagatcactctaatgtctgcttctgtcatcacacccccttctccctgattgaccctctcgtctctctaaggattcatgtgattatattaagggctcatctcaataatccaggataagttctttatctcaaggtccttaatttgttcacatttgcaaagtccctttgccatataaggtaacatattcacagagtccaaggattgggatgtggatatctctgtggggctattattcagtctaccacaaatgtgcactcctttctaaagtatttatcttcgagcactgaggggaactctgccttcagctaaggctacacaactatcctgatggtggactgtagcaacttgtaggcaaggggtacagctcagggcagctacctctccttcttctcgggccaacctggaggaagttccttccagagtccaggctatacttgcttctggcctgcaaattcctgagaattctttgaaacctaggaggggcctgggtattatgcccttttgagtgagaattcagaggccagtggaattagggcaatcaggcatttcctgatcatctgctatgctccaggatgctgacttggagagatgaacaaggcaaaatgctcattctgacggcactcagaatttcacggggaactggaaggataaatgaatctgggaggaactgctaaaacaggtaggagagggtaagcttgttagaacctgagcagaatgctgtctgaaaaggtagagaagtcaggagaagcagtgaggccctcaaccctgtgtgtcacaatgcctcctgtcatttcctctctgagtttccagtacaagcttctcggtggctgttttctgcccaagcacatgaactttggaagacctagcactttggacaaagtccctggccctgacacttaatagtttggggaacttgggcaaaatactcaaagcttcctagtctgtaaagtgagaatgacaaaacatctgccttccttgcaggattgttgtggtgatgtgtaagacataaaatatcaagcatagtcagcagtcactgagcttaaggaatgttaagttataatcattatttctgaacttcagtgcccaatatgaccctgttgacacctcctttgcctccttgggacatactctcttctggtggtcctcatccctttccagctatcctctgtctcttggtattctcctaatctaccaactcccatcaatgttcctgcttgcccagggtgcctgtctcagtcctcttcttttctccctaacccctgggaagatctcatcaaattccctgcctctcgttttccttatcgatttgctgagggcttactcacaagtttctccagctgagaccctttactgatgagagtaataacaactggtggaagtgttctcctaggtagagaacaggaatctcaatttttaatgttgggagggactttatgcatctttttgctttcaaaagcaatttctgcctgggcgtggtggctgatgcctgtaatcccagcactttgggaggccgaggtgggtgaataacttgaagtcaggagttcgagaccagcccagccaacatggtgaaaccccgtctctactaaaaatacaaaaaattagctgggtgtggtggcaggtgcctatgatcccagctacttgggaggctgaggcaggagaattgcttgaacctgagaggcggaggttgcagtgagcagagatctcgccactgcactccagcctgggcaactgagagagactctctcaaaaaaacaaaaacaaaaataaaagcaatttcttctctctgcattctccatgttactgaaacctaacatcaaccccatagctcctcaggccagaagctcctttattgcatgcattctccaaatgcctaaatcaccaatttttttttctttctttctttttttttttttgatacggagtcttgctctgttgcctaggctggagtgcagtggtgcgatctcagctcactgcaagcaactcctcccgggttcacgccattctcctgcctcagcctcctgagtagctgggactagaggcgcccgccaccatgcccggctaatttttttttttttttttttctttttttttagtagagacggggtttcgccatgttagccaggatggtctcgatctcctgacctcatgatccgcctgccttgtcctcccaaagtgctgggattacaggtgtgagccaccgtgcccagccttttttttttttttttttttttcgagacggagtctccctctattgcccaggctggagtgctggagtgcaatggcgcaatctcagctcactgcaacctccgcctcccgggttcaagcaattcttctgcctcagcctcccgagtagctgggactacaggcgtgtgccaccacacccagctaatttttttgtatttttagtagagacagggtttcaccatgttggccaggcttgtctctaatttctgacctcatgatgcgcccaccttggcctcccaaagtgctagaattacaggcgtgagcctctgcgcccagcctgtttcttaaaattaatatgtcttattgcatatgtgaggtcaaggtgtcatactgtctcatcatttccacctcctctttcacaattcccattctccattttattaaaaatgaatgaatgaataaatgattatcacatgtttaaggcttcctgaatttaattatggggcattccattggggtgtaattacctgcagcataatattgtagaacaactcaatatatggaagcctcctttagtcaagaaattgtaatcctacactaaggctacatgtttttgtctttatatttttgataagggtgcagcataatatagaaacaaggtatttggggacatcctgaattcatgtacattgaggagtgaagtggcaggagttatggcaaattttgttgaagggtcttgccttttgcattgcctaattatgatcaaataatgcattgctactataggagagttctgagagggcaaagtagagaggctcagtacaaaatacagaacttatcagagctcattccatcctggagacaaacttatgacaagactctgtgccttatccacctccctgcctcctttccttcctgtctttttatccatcttagaattaagatatttaaattttgtctgaagcatgtcagagaataacaacatgctataaaatttcacttgtgttcacccatgtgtcagctgagtattttgcattgttacatttttattttactgtattttattttattttttttttgaaatggggtctagctatgttgcaaactcctggcctcaaactcctgggcgcaagcaatcctcctgccttagcctcccaaaatgctaggattacaggtgtgagccactatgccctgcctattttgcattacttcaaagagaaggtgaggtcacacatttacttccaacagatcaacattatatcttcaagttagcaaaagcaattgaaagtaggtagtggcattctatatttccataaatgctcctttagacttgtaaaaaaattatcattaattttggccaaaagcttattgatgtcataaaaccatactcagtttttacttggacacattctcctgctgttcctcatcaaccactttgtgggtttagtcattcaaagtatgtacttactagatttagattaattcaatggagatatgttgtgaattcaactgaaaataatgcacttaaataataattactgtatcttttgtaatcagcacacttaccagagcttcaacacctgcctttccttttgctatttatttccacaagatagattaaactacatttttaacagtagaacatttacttatgtagaacaaaatgttcctaagctgtaaactactgtgtaatgacctgaacactctagaaagccagcttcattacatttgttttgggagtgcgcacataaaatgttgaaggaccactgtattaaaaggctattagcataatctctaggagacacaaccagaaaaccaagcatagaggctgagcagccagaaccaatactgctaccgctgtccctgccactcaacacaggccaaatagtgggcagggatgctatgccaagcccctgccttgattctctctggaaactggatgtatctttgctgcctctctgctgtcacctgaatggattccctcaggaccccgtcttcatgacttcagtcttccacactgaaatcacatgcaggagcactgattggtggagtctgtgccacaatttttcctcacttcaagggaatctgggaaaatttggcctctattttcaaaaggcagactcactagatgggagagtcccaaatataaagagtattcaaagcaactagagagcttagaaaaaaaaaaagaatgacaaatgctatcacacaaagtatataataacatatgattttaaaaacaaatattttctttaattcattacatgatcgaggattgcatttatgatgttcattttactctaatgctttactataacactgagccagttttatgtttctccccattcaaaaaatgatgcatgctcctcaaatttactttaaattaattgcatgaaaaaggatgattagtcaataaataagtcttgaaaagacatattctatagtgttcggtttggggttttcagattaaaatacacattgaaatttactacatgatataacaagaaaaaaactactttcaaggcctgatatttgattcttctatcttgtatttgagaaaccaatgtattttacagatttttacaaaacaaagtagatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaacaaagtagacattaattccacttttaaggatgtaaagcccccagggtaacatggtaaacctgtcacggatcatgacccactggataggaaacactgttttactattctctgggaggtatgtgaatctcaacttcctgttgcttcctgaatctacttgtgacacagtcacaactggagtggcagtagctaatcccggactgtccctgctgcttgagatcatctaatcagtcactcctccacctcatctttgtctgtttgatgttgaaattgtattacatgcttgaactgatcaacaattagatggctagagaccattttgactggctgcctcccagtcctgcaataaaacacaacaaaactgtaaaactatcccaacccaagaaaccagagaactaacccaacccaagaaaccagaggactccctgcgcaagaaatccacactggccctagagtgtcccacgcaggtttgaacagcaaccctggacctgtgccacaaactcaagtgcaaggggactccggtggaccctgtaatggcctatctgatttggcttctcatttacagagaatggagactttacacaccacaatgtattgtttgcttaaaggtgcttagaaagaacaacctgaaaccttttaatcttatttgttcatgtagaaatgaaaccgttgagaccttatcttaatgcatatagtattccagttgtaatcagcaaccttttagttaaaggaaagtaacagccggttgagattgttacttttccttttaccaacccataaaatggagacaagggactagattaaatactaaaacagggaactaatctttcagcagccctataggagttagaagcaaaggctcctgggccgggcatgatggctaatgcttataatcccagcactttgggaggctaagacgggtggatcatttgaggtcaggagttcaagaccagcctggccaacatgatgaaaccccatctctattgaaaatacaaaaaattagccaggcatggtggtgcaggcctgtaattccaactactcgggaggctgaggcaggagaatcgcttgagcctgggaggcggaggttgcggtgagtcgatatctcgccattgtactctagtctgggtgtcagagtgagaccctcttttttttttgagaaaaaaaataaaagaagaagcggaggctcctgctgttgaatagacaccctttgaggcaatgaatgacacatgttagcaaggagcccatcttatctacgactcatcctcaaaaggtccccaacctgaagcagccagtgcctgtggtggtgtagatggtgtctggaaaggctgagaggacctcacttctttcactcaccaaattgagtacctgtaatcccagcaccttggggtgccaagacaggaggatcccttaaggccaagagttcgagaccagcctgggcaacaaagtgagaccttgtctctataaaaaatcagaaaattagccgggtgtggtggcaggtgcctgtggtcccagctacacaggaggctgaggcaggagaatcacttgagcctagaggtcgaggttgcagtgagccatgattgcaccactgccctccagcctgggtaacatagcaagaccctgtctttaaaaaaaaaaaaaaaaaaaagattcgaagatctttgaacattatagagaacattacaatggaatgttatagtattagtattgttgatattttaaaacccaggagctgttagctcctcctctctggcctcttaatcataaatccctgtcccttctctattgggttacaagtcaactgaggcaccagcatgtaagcctcatctatacttactcaactaattcagacaggtctaggcctgtagggggtggcgtggggtgcagtctgggtgcaggggagagatggacccaccagggagagctaattatatcacaagtagaggaacctgtgggaagagtatagtgttggacatgtgggtgctgctttataacctcttcatttctcaaattcctcaaggagaacctacattaaggggtgaccaaccagctgaacaattccctttgctgtcaatctatgacgaggggtaaaacatgactagtgcactaaaatatcactggaaatagaacttcaaagatgaaaatttttttaaatcagaaatctcacagagagtactcaatagggttggagtaaataccttgatgagccacttggggatgggggtggaaggtaagaccccaaggggtatgcctggatgacaacagatggtccttctaaaaaggatagtcaagtgaactatgaggctgttgttttggagagaggttgtaagtttggggccagagttaaagccccttggattttggaggctttgcagctgatggtcctcctctttatcctttttctacagggcactgaggaactatttaaagaaaatacaacccaagtatctgcaggtctcattctggtccagccccaaagcagtgttagctgcaggggaaggccttaccctgaggagagggagataggatgtaccagctgatgtgggggagtgaggacacaggattagaggggagtggatactgtgaattgcacctagaaacaacagcgctaaggcaggcttcttccccttgaactatgcttccattaggggaagaatgcataaaatgagtaaaataaaagctgcagaccaggcatggtggctcatgcctataatccctgcactttgggaggccatattgtacggattgcttgagcccaggagttgaagaccagccctggcaatgtagcaagatcctgtgtctacaaataataatttaaaaaaattagcctggcatagtgacacatgcctatggtcccagttactcaagaggttaaggcaggaggattgcctaagcccaggaggttaaagctgcagtgagccatgatcatgccactatactccagcctaggggacagagtgagaccctgtctcaattaaaaaaaaaaaaaaggtatattccctgggccaggttttctctctctgtttatctggctaactcaaatttaacctttagggttgagattagatcttacttctcccaggaagccttttctgatctcctaagtctgcattagatgtcattcctctgtgctccgacagatcctgtatttcccccatcatcacagcatttacagtgtgcattgtcattgcttggttacaaggcaatttcctttgctagtctataacttccatggggtagggaccatgtctgtagttcactgtcgtttggtgccaaacatagtacctgatacctggtaggcactcaattatttgttgtttgaatgaaataatagaggcacaagaatagtgctgccatgtacctagaagaggtggaaaattttcatggtggagggtggctccctgaggccaggccttggtatagaggctgatggacagaacagtagctcgtggatttcgggggcagtgatggcttcagacagcctgatacgttaggaggagagaggataccaaaacagcaccttcgaagtcaggagctacgtggaaacagaatggaagacatcagctaaaagacaccctagggacttctgcctctcctcaccctctagcaatataagtgcggaaggagaaagtccccaaatacagtgatgcaccacttaaaaatgcattctgagaagtgcattgataggtgattttgtcattgtgtgaaccttatagtatgtgcttacacaaatgtagatggtggagcctactacacacctagcctgtatggcgttgcttattgctcccaggtggcaaacacgtatagcatgttactgtactgaatactgtaggcaattgtaatacaatggtcagtatttgtgtatccaaacatatctaaacatagaaaaggtacagtaaaaatatggtatatgtgatattttggtatacatattggctttcgtccgcagctcctgactcataactcccatagcccttgttatataatgttggggtgcttcaggcctcagaaaacagaatgtctgtctctctggccttccgaccacctcctgccctcctttttctccccaaggcaggactcttctctcacctctcttggagctgaccataaagaaattctcttacctaccctatctgactgtaggtcataagaacccccaattcagaaggagtcctgccccacacccaggaagaacaaatgctgcacagagatgccaagaagaatctgaacagacaggccttgctgggtttctccactcagtctattagtattagaccatacccttcttgcccatttctgcatgattgtcaatcatgactacccaatgaagtctccacaaaggcacaagaggactgggtacagagtatttccaggtagctgagcacatggaggtttctggagagtggcacacccaagcagggcatggaagctccgagccccttccccatacctcgccctgtgtgtctctgcatctgcatgctttgtggtattctttataatatatcattttttgtgtattataaagaatatataaatgtgtttccctgagtgctgtgaacagcactggcaaattaatcgagtcaaaagaggaggatgtaggaatctcaacttaaagccagttggtcagaagttccagaggtccagacttctgacaggtatgtgaagtaggggcagtcttggggactgtatgatctgacactatctccaggtagagagcatcagaatgaattgaactggaggacaccaagctagcgtgtctgtagaatcgactgcttgcttggtggtggcaagaaaccgccatacatttggtctcaggagtcttttgtggttgtgatgtgagaggagagtaacaacagtttttgttttttccactaagtataaaagataaaaacgtatactcctgtatagggcacttaccataaatagagtttgcaggactcaacgctgttctgggtgagtcagtgagtgagtggtgagtgaatgtgaagggctaggacattactatacactactgtggactttataaacactctatacttaggctacactaaatttaacacattttttttctttaataagaaattaatctcagcttactgtaaattttttactttataaactttataattttttaaactttttgactcttttgtaataacacttagcttaaacacaaacacattgtacagctgtacaaaaatattttctctgtttatatctttattctataagctttattctattatcttaaatttttaattttttctttttttttttgttaaaaactaggacacaaagacacacattagcttaggcctacacagggtcaggatcatcaatatcactgtcttccacctccacatcttgtcccactcggaggtctttagggacaataccatgcatagagctgtcatctcctatgattacaatgccttcttctggaatacttcctgaaggacctcccagaggctgtttaacagttacctttttttttttcaataagtaggagtacactctaaaacaacaaaatatatagtaaatacataaaccagtaacatggtcatttattatcattctcaagtattatgtactgtatataactgtatgtgctagactcttatatgactggcagcaagtggatctgtttatactgggcatcaccataaacacataagtaatgcattgtgctaggactttatgacagctacatggttattaggctacaggaatttttcagctccgtgataatcttctgggaccccgtcatatatgtggtccatttggctgaaatgtcactatgcagtgcttgactataatcctgcttgcagcattttgtaccccaaccataccctcaggatgatatgcctggagaaatgccagttacacctggccgtaacacccacagtcttggttcatgttctcatcatcacagttgcattagatgccttaatgatcaccctcctctatttgggccatggagccctttgagaatccaacaataactctgaacctctccacagaagaatcacatggtcacacaagcacaaaattttacatataacagacaacccttaaaagctaatctacagaccctagctctcatcttaatcttttctaaatttttctccatagtgctgccagggtgaacttgaaaaataaattttattgcattgttggatttttattaccttcagggaagacttcaagctccctagtaaagtacatgagacacctcccacatactgctcacgttccttacctaccttttttactccaccactgctgcagcaatgagctggtgtgacccatttctttggagaaatgtctgctcagatcctttgcccattctttttggttcccaagttttattcaagaattcattcaaaatattccagataaataaaatttaatcctcatctttctcttcttctttgtcctggttaatttggaaataacgtaattcataactctctttactgttagcaactatgcacaaccaatcacatagattattgttcttcaaatattttttggtgagatatttcaaataccttctggaaaaaggcacttccggtgttacggtgagcttgctcttgctcctttcgatggtcaccactcctccaagattcacagcttttctgttcactttgatcctctcttgcaaaaactgctcaaaattggtagaatggcggcatccatgattccatcttctatggggtggatgcaatcaagagtgaacttcagaacctgcttcttttttgccccctttcaccacaagctttttcgcgggcgccatggtggcaatggaggcagaaaagccctttgcccatttttaaaattgggttatttgttcttctgctattgagttgtaagagttccttatattttttggatattaattccttatcagatatgtggtttgcaattatattttcctagtccgtaggttgcttttcaagtttgttgattgtttcctctcctgtgcagaattttttagtttgatgtagtccctttatttatttttgtttttgtagcctgagcttctgatgtgatattaagaaaaagaaaaatcaggccgggcgcagtggctcacacctgtaatctcagcactttgggaggtcaaggcgggtggatcatttgaggtcaatagttcgagaccagcctggccaacatggtgaaaccccatctctactaaaaatacaaaaattagccaggcgtggtggcacgtgcctgtagtcccagctactcgggaggctgaggcaggagaattgcttgaacccgggaggcagaagttgcagtgaaccaagattgcgccactgcactccagcctgggtgacagaacgagagattccgtttcaaaaaacaatcattgtcaaggcaaatgtcgagaggtttttcccctgtgttctcttctaggagttttatggtttcaggtccacagtacactgttagtgggaatgtagattggtacagtcattataggaaacagtatggaggttcctaaagaaattaaaaatggaactaccatatgatgcagcaatccctctcctgagtatattcccaaaggagaggaaatcatcaccttgtaaacatgtctgcactcccctgttcattgttatgttattcacaatagccaagataaggaaacaaactaagtgcccattgacatttaggatggataaagaaaatgggttttgtggtgtacatacaaggtattttcaaaaagttcatggaaagtctgtattatataaaaaaaaaaaaaaaactatgtggccgggcgcggtggctcaggcctgtaatctcagcactttgggaggtcgaggcgggcggatcatgaggtcaggagatcgagactatcctggctaacacggtgaaacaatgtctctactaaaaaatacaaaaaaaaattagccgggcgtgatggcgagtgcctgtagtcccagctactccggaggctgaggcaggagaatggcgtgaacccgggaggcggagcttgcagtgagccgagttcgctccactgcactccagcctgggcgacagagcaagactccgtctcaaaaaaaaaaaaacaaaaacaaaaaaacaaacaaacaaagaaaacactgtgtatggatttcaaaattgttcacaacaaaataaactagtactaacttgtttataacatgtctggtcaggatctagttagagacactaaggacaacacatcagtttgaaaagagtcccctgtcggagcaacatgaattctgctaaaattgaagcaagaacaagcatcaaatgtatggtgaagcttgtgtgaaagaatgatcaaatcactgattctttacaaaaagtttatggaaacaatccccaaagaaatcagcagtttacaaatggataacttgttttaaaaacagatgaggcaatgttgaagatgaagcccatagtggcagaccatccacatcaattttcaagggaaaaattaatcttgttcatgccctaattgaagagaattgatgactaacagcaaaaacaatagccaacaccagagacatctcaactggttccacttacgtaaatctgactgaaaaattcaagttgaataaactttccacgcaatgggtgccaaaaccgttgcacccagatcagctgcaggcaagagcagagctttcaatccaaattttaaagaagtgacatcaagctcctaaagcaaaacaattgtaatgggagatgaaacatggctttacaggtacgatcttgaagacaaagcccaaagcaatggccaccaagaggtggaaatggtcgagtcaaagcaaaagtggattggtcaaaagaaaaggtcatgacaacagttttgtgggatgctcaaggcattttgcttgttggcattctgaagggccaaagaacagtaacatctgcatattatgagagtgttttgagaaagttagccaaagctttagcagaaaattccctgggaaagcttcaccatagagtccttctccaccatggcaatgtccctgctcatttctctcatcaaacaacgataatctttttagagtttcattgggaaatcattaggcatccaccttacagtcctgatttggcttcttctgacattttttggtttcctattcttaaaaaaaccctataaggtacacccatttttcttcagttagtaatgtaaaaacgactgcattgatgtggttaaattcccaagaccctcagttcttcagagatggactaaatggctggtatcattgctttcaaaagcatcttgaacttgatggagattatgttgagaaatagtttatattttcaatttttatcttttaattccatttttccgtgaaccttttgtagctccccccatacaatggaatattatgcagtcttaaaaaaagaaaaggagaccctgtcatttgccacaacatgggtggacttggaggacattaggctaagtggaataatccagatacagagagaaaaacattgcatgacctcacttatacatggcattttaaaaagggctcaaatacacagagagaatgaaacagtggttaccatgattgggtggtggggagaggaaatgagacactgtaagtcaaaggatacgaaatatgaaaagtctccacatctaaggtccaacatgaagactaaagttaaaaaaaactgtatcatattgggaatttgtgttaaataagtagattttagctgcccttgtcacaaaaaagtaactatttgagatgatagaaacattaatctgcttcataactgtaaccatattactatttatatgtatcccataacattgtgctgtaaacctcaagtatacacaatttaaaaaattttttggctgagcacagtggctcacgcctgtaatcccagaactttgggaggccgaggtgggtggatcacctgaggtcaggagttcgagaccaacctgatcaacatggcgaaaccccgtctctactaaaaatacaaaaattagccaggcatagtggcacacgcctgtaatcccagctattcagaggctgaggcaggggaatcgtttgaaccctggagttggaggttgcagtgagctgagattgcgccattgcaccccagcctgggcaacaagagtgaaactacatctcaaaaaaaacaaaatatttttttttttaatgacctctccccaattttcattacctgaccttcctctaggatctcatggtcctgggctcccctcttcatagcacttactgctgagctgtaaatatccatttatgtgttgcctccctcactggactgtaaaattcttgaggcagaaccagtaggttttatctatttatccttctcaagcctaggacagtgcctgagaccttgaaactcggtgattgttggttgacaggttgaatgagtgatctatgagatttctgaatcaagcctggtgcatttaatctttgggtcttgataacatctggatctgaatgaatctgggggaaagtctaattgagcttgatttccctgtgacctgcagaggcaggagtcccagcttgactggtagagtgggtggggaaggcctcttctacagcacagccataaaaaatctggaattgtgacactttcccctaatgggcctcctgggactttacatgtcctgttgtggggagttgattttaacacagaatctgtcaatgctctatccttttcaggtccagcttcataaaaatattcaaggaatcatgtcttctgattttgcttgatgatccctcttgggagccatatttgaaaggttacagtttgcatttttgacattaaagtttactttttaattttaaaaaaagttacaaagatgtaggacgtttggcttcttcaatacttatttgctagaagactttgggcaagttacctaaactctctgggcttcaatgtcctcccatacatgtaagctaaatgttccagggccacctatgcccatgggtaacaggccagcacaagaatatgctgaccaattgattcctggctgcataaccacagaatctcctctgttatttctaggtgcctagaggaggtctctcatagatgcccacgttctcttgacaagatatttggggaggacccctggctactgtcactgctgccatgcctgccaggaggaggcaccttcctgacacttcactgctgctgctcagcaggcctgccaagtggttctgctgtgttctaggagaaacaggaaaaatgcctctcctcccactttgcactgtgctttgtcacctgggccctaaaacaccattgcctgcccctgacgccccaacagctccctctaccaaactgaggctgggctgggagactaggcactacaccattccattctcccttctcttcttccattctcccttccctccctctcttcttcccactgcctccaagacacctgtactggaactttgtccattcttacactcacacacacacacatgcacatgcatatgtgtacacacaaaagtctcttgtccatcagatcatacaaatatatgcttgggacaggggtgatcacatgccccacatgcccagtggacatttaggctcagataggacaattctttcacaaggatgacaaaacctaccttccgtggttgctgtgagaacaagaaattgtacatacagtgcccattctacagcaaacccaacaatgatttaaaatccacaataggccgtgcggtggctcacgcctgtaatcccagtactttggggggctgaggcgggcggatcacgagatcaggagatcgagaccatcctggctaacacggtgaaaccccgtctctattaaaaatataaaaaattagccaggcatggtggcaggcgcctgtagtcccagctacttgggaggctgaggcaggagaatggcgtgaacccaggaggcgaagcttgcagtgagccgagatcgtgccactgcactccagcctgggcgacagagcaagactccatctcaaaaaaaaaaaaaaaaaaaaattccagaatatatagagagcaccttaagagtcaataagaaaaaaagacaaaccaatatacaaaaagtgagcaaaagatatcaacaattaattgaaaatacaaataaccaataaaaatatgaaaatatattcttaatcttattaagtatgcaggtaaagacaaattaaaacaatgaaataccaatttttattcatcagattggccaaaactaaagcctgaaaatataaagtgtccatcttgctgtgtgtaaatgggaaatctgaatctgatggtggaggcgtaaattggacagctttttgaaaagaatgatttagcagtatctattacaatgaaaaacatagatacctttgcctcagtaagtttacctccaggtgtgtatcctaaagaaatacttagaaatgtacctccaagagacatgtacaaggaagttcccttatgcattgtttgtaaaagtaaaacagtgatgatctcaatgcccactgataggggaaaggtttaattcaccatgattcataaataaagagaaattctatataaagtggaatagatttgtgtggcatggaaggatcgccaaaaagtattttaagattaaaaaaaaagtaaaaaatatgtgcagaattatgcctttttttcatagaaaaaagtctaggggattcaccgctcagcaggccatcctggctatctgggcataaccaccacccagagtgtaatttcttctaaggcaatcacccaagtctttcacattttataccttcacagccctgacaaaaactgctacataataaacactaaacaaatgcctatgaaaggcaagaaggacgtaagagagggaaagaagcaaagaaatgaacaatcgtagcacctgaggccggattaaagaaaggaaaaaagcttgtaagggtcttttcatattgacaaagctttagtggaacactcttttggtgggttttcaagggatcagaacgtttgggcagaaaacagaaaaatacagacataaagaagagacctaaatatataagcataacattgggaaaaagccttttcagaactgcaactcatgccttattcgaacatgttctgaacaaggtctcttatctaaagttgtttctggcttcagacagcaggtggcagcagaatcaagctttctggttgcagaaacttctggagccagccagctgtataaagtttcaaatggttttcggaggagaagcagcttttgagtaaaaacctttaatctaaaaatctaaactcgacacaaaacaaaaacaaaacagagtgaggagctggtgccattggcccctgccatgacagatcctgatgtcattccctgcctgccatctacagagccacaccttgtccttcgaagaaattctgggatttctactggcagcggccaggaaaggaacccaaggttggtctgtcctgttctgacgttgtccttgtcacatgtggaagctggttcgccaggaaacaggctctggtcaaggctgggctcactggagaggtcagcccaaactcaaaacacatttatgggtaaaggaagggttttttaaaaggagactttgcaggcaacaaaaagaaatatagtattgatatatgccacaatgtggatgaacctcaaaaacattatgttaagtcaaagaaatcagtcacaaaaagaccacataatgcatgaaaccatttataggaaatcttcagaataggcaaatctaaagacagaaaatagattagtggttgtctagggctcaggaggtggtgactggggaatgactgctaatgagtacacaatttctttggggagtgatgaaaatattctataattagattacagtgatgatgcacaattctttaaatatacttaaaaaccattgagttgtacgctttaaatgcgtgaactttatggtatgtaagttatctcaataaagctattaaaaaagggaaaaaaaaaagggcccagcactttgggaggctgaggctggaggattgcttgaaaccaggatttcaagaccagcctggacaacatagtgagaccccccatctctacaaaaaataaaaactagctgggcgtggtggctcatgcttgtattcctggctactctggaggctgaggctagaggactgcttgagcccaggagttcgaagacacagtgaactatgattgtgccactgcacttcagtctgggataaccattcaatgctgggggggtggggagagagagagagagagagtctatgcagttgctacagaaaagaattggagattggttagagatatgactggtacattgatgaattttactttttgatcagattgtgatatgatggtagcataattcgcttcctgatttggtcacacacacttcctatccctaagaactgcaaatacttacctgaaagagtggatgaggtgcgttgccatctcacttttttaggggatggtgctctccctggaaagaaggcaataacaggccagtgaaatagcagacatctgaagtcacacagacgtggtttcaaattccggttcttcctcttattagctatgagccgtcagcttcttttccatacccacatctcaaggttaagtaagaattacaacataaaatataaaagtgcccaacccagagtaaacttgaaatttatttaatattcttggaatttccatcctgaccagtaagatgacattttatctcaaaacacagctgtatcatgttttgctattggtacacctctaaagatcttctccaccgccctctgcccccaccccaactccaagtgccatgaataacctaacttattatcactttttacaacgatgagcagcctctgagaatggaaaaataagtcaatggtaatactgtgttaggaaggatctgagtaggagggaacctgtcccctggctaccagaaacacaggactagacccagtaatacacacctagaatataagcctggataacaacagtgcaggagaaacactgtcctcaccaggatagcttttatatgcaagaatttaggtattataatcagaaagatttctagaaactatgaaatattagggaaaaaagccaacacattagccaacattgtactttacatttatgcaaattttaaactctataggcacctcctagtagctttgggggaaaataatactctgtgcatcgtgtaatggataagaaaatgagttaaagggccgggtgcggtggctcatgcctgtaatcccagcactttggaaggccgaggcgggtggatcacctgaggtcaggcgttcgagaccagcctgaccaacatggtgaaaacctgcctccactaaaaacacaaaattagctgggggtggtggtgcatgcctgtaatcccagctacttaggaggctgaggcaggagaattgcttgaacctgagaggcggaggttgcaatgagctgagatcgcacccttgcactccagcctgggcaacaacagcaaaaactccacctcaaaaaaaaaaaaaaaaagaaaagaaaagaaaatgagctaaggagctaggcttccttatttcacaaccttggctctgtctcctatgaaaccagggcaactatttaacccctccatgtctgagtttcctcatgtataaatgaagggagcaatagtacctagcttataaggccattataaggattttaaaagttaatctaaagtgcttaggacagtgtatggcatagagcaagcactcagtaaatccattcattcaataaatgtttattgaatataggtgtggctgctgttttggctgatgagtatactaaagtcagtgaaacagacgaaatctgtggagctttcttccttgggggaggaggccaacaacaacaacgaatacacacagaggaagagcaatggaatgaattgtgttccctcccctcccaaattcatatgttgaagccctaactgccaacgtgatggtatctggagatggggcatttgggaaataattagatttagaagagatcatgaaggtgggagactcgtgatgggattagtgcccttttaagaagagaaagagtcaggtgcagtggctcttgcctgtaatctcagcactttgggaggccaaagcaggaggatcgcttgagtccagagtttgagaccagcctgggcaacatggtgagacgccatctctataaaaataaaaataaaaaattagcccagtgtggtggcacacacccatagtctcagctacttgggaggctgaggcgggaggttgaggctgcagtgagctatggttctcatcagtgcactccagcatgggtgacagagcaagactgtctcaaaatgaaagaaaaaacaagagagagagagagatacaccagggctctctctatgtcctgtgaggacacagcaagaaggcagctgactgcaagccaggaagagagcccttaccaggaactgaagctgtcagcacctttatcttggacttcccaacctacagaactgtgagaactaaatgtgtgttgtttaacagacattttgtctatggtattttgtttgttgttggtatttgttgacattttggtattggtgtgttgtttgttggtattttgctatcagcaacccggcagactaatatagatttatatgtaaacatatatttgaataggaaccctgcagaagccacatagctggttttactgatgcaaagagccctatgctatagtatgatgaggtgaagggcttacatttccctttcagcagtggtatccactctccacagcgtagacttggagaagccacttgactctcatcttagattcctgcatctgtaaaatgatgaactagatgatacccaaaattttagattctatccatcttatggttggaataacagcccaccttctaggtcaattacacacacaggtgtgctgatgcttagggtggcagagagggtgtcccacaagtagacactgattatcctaactgtaactttcaaatggaaaattaattaaatctctaaatttggatttggcttcctagttagcactgtttccttcctggaaaagaaatagttatgtgtcagacagaacagccccctctgatcatttttttccttcttccttgcattattgttagctctgactgtgcagctctcctggtgtctctccctttctagataacagcctagaaaaaggagcttatggtttccctgaggttcttttgataaatggctgacatttgattgaaccattctcatttcacttatttttcactttcacagaaaaactgtagtaggtataacagcacaaggtaatcatttttaaattattcagacatttttaaaaatttgattctgcttctctcacctctgaaagatgttactggggtgtcttggttgcaaagattcattcaagttcttttgcttttggattctccatattctctgaggaagtgactgcatctaagactgtgtccaaggaagcatcttatcactttcatcctttgatccctgagtgcctttcactaccagatatactaaaacaaaaatcttctcttagctccctggtgcagtggagttgagggataaccacaaagaattcagagtacatcacataacggaactgtcaggaagcttttgatggcagaaacatattttcctggtgatgagattagaaggatcttcatataaccatcagatatgttattgtcacttctgaacaatgctttttatagcagattgtttctcaaaaaggaaatagaaatgcgattttaaaatatgaaaaatatgttcaatctcattattaagataaatgcaaatacaaattataagaggacttaacagattggcaaacatcagaaaagtgaacaacctcctccactggcattcttttttttttttttttgagatggagtttcactcttgttgcccaggctagagtgcagtggtacgatctcagctcactgtaacctccaccttccagtttcaagcgattcttctgactcagcctcctgagtagctgggattacaggctcctgccaccacacccgactaatttttgtattttcagtagagatggggtttcaccatgttggccaggcttgtcttaaactcctgacctcatgatccgcccgccttggcctcgggagtataatttgctgtatggagggcaatttgacagtatctatcagattttataatgtacagagccttgaattcagtaattctacttttaggaacttatcccacagatattccagacatgctcaaagatgtaggtacaaagattttattgcagtattatttgtaagagtaaaaaaccagtccatgaggaagactagttcaataagttaataatctagaatatatcgatataatggaatactatcaaagaacaattttcacaatgtatttttaagagggggaaggtacagaaacatatgtaaggagtttcatttgtttaatatacaattagtgacacaggttgcatctggggaggaaaattagggaacaattttttgttgtacacctttatctttcattgtatctctttcaaaaccttttgtaccatttgtgtgtattgtgtattttaaaaattaatttaaatttcaacaaccgttatagtgatgcaaaaaaccctatagaaataacagtttacattcaattttgctatatgtcaggtactgatttttcaaccacaaccttgtaagatacgtgctattatcatccccacttcacagggggaaacctgtggtagagagaagctgaataacttgtacaaggattcatacctaatcagtagcagagctcagatttgaacccaggcagcctgtttccagagaccatactttacccaccattctatactgctctgaggtcacagacctccatgatgaactcttaattgagtgcagtcaataggaaactcagataaactcagatgtacaagaaatatctcacttcttcatttgcttttcacctacttaactctgactctgagtccccatccagcttgattggcagaaattgtaatctcagtcattatttggactctccactgcaagggtttttcaaggtcctggaatcttacatggcaccaaagcttggcagagatcctgccagttgtcaatacatactggttaccactgacatgtccattgcagtccagtactctcctgcggccatgtgtagtcctactcaccctcacccatagactgaaaacttccttatattcttgggaaattttctcctttccttttcctgctgccttcaaagacattgataatactatcttcattgagttcaggttttatctacagacagctagatcattctgcaaaatatctctaaggtaagaaattactaagggcctacctaactcacttagatcaaaggggtagagaaagtacagaaagtagacaaagaaattaatatttcaatagattatcctgccacagagtcatagccatgaaaaacaataactttggatttggaatttacctcctacctcaagtttccctctgcaagtgtttggacttgcatgttatggaatgatgattgtaatgaaccatgccttctattggtagcagattttgactgagatataggacagttaacaactgcagtttgaatgcaaaggcagacagagtacactttgcacaagggacaaagaactgatagggaaacaaggacagtctccttttacaccttaaaaatcctcaaataagaacctggcttctgctcagctaaccgacacataagtgcagaaaaaaagacaagattggaatccaaggaaggaaatgttagaatccaagggccaggaatcaaagagaatatatttaaatagaaaccaggttgatactagaactttgggatgcctagagtaggcgggaaaaagatgtatgatctaagcacaggatatttcgaatacaggagcttggataagaagtctatcccaaattccatctgccaccaatgaaagcagaaaggaaatacgtaatgagagccaagccatggggaaatagtccaagatgggtgtgcctcctgtgtatttagtaatcatgtccagctcagcaaatctgagtttctttattccttgagccactgtccattttaatgaacagggaacatttgatctcaagcagcttcagaaactcaattttcccccagcctttgtctaggttttatagaggaaaaggtatagttgcagtactggttgatatttgcttgtgagagctcttgggcaggtaattcttgatcctttgctccacctagtggatttccaggctagagagactctggaaaagagatcagtgatcagaagggtgtacatttgctgataaatgagacttaccagtcagtttctggattatcgtcagtttctggattatcgtctgtttctttactgacgatacccgattccatcccaaagtgtccttgtttgaattgattgaaatctttcatttatttccattaatgccagatgtgtagctgtaagtcatcaaaatctaatgcattccttttctctcttcttaatatataaataacattatataatcaggagacccatatcagcacaagaaagcatattctacttataattatatcctctgagggccaaacacactcaaacctcaacagagtcatttaattaaacaatgacctacctgcttaacactttggggactcctttgaacaataattggttaaagagtcataggaccctttctcaagaagtttcacatccaattataaaaacagatgaaataacactggaaagcagggcgacgctgaaaaatttcaggtagaagagaattcagagctgactcttacacaatatccatatgtggagataaaattagtgttaatgtaggtttaagccattagagttacaacataaatttgacaatctatgcttacttgctggctgaccatgtccctgtcagttaccagccttaaaggctaccaaggcattattctttattccttacctatatttaatacttactttttgttatgggttgaattgtgtcccccaagtattcatatgttgaagtgctaaccctcagtccctcagaatgtgaccttatttggagatagggtctttatagaggtaatcaagttaaaatgaggtcattagggcatctctactccaatatgcctgctatccttataaagaggggaaatttggagacagatgcacacaaaggaagaacaccatatgaagatgaagatggccctctacaggccaaggagaggagcctggaatggattccttcctcacttccctcagaaacaaccaactctgctaatacctcgatattgggttcccagcctccagaactgtgagaagataaatttctgttgcttaagtcacccagtttgaagaactttgaatggcagccctagtgaattagttcaattgcctctggcaaatgaataagaagctcactgcaaaaatgaaattaatccaccgagtgctagagttggacgggatctcagaaaatgtattgcacaatccccttgttttgaaataaatgcccaaggtcacacagcaagttggtgacttagtcactcttttagctcaactttcagtccatcaacgttctatcacagtctgccaactatttcaaagatggtggcaaaatcagccaatgatggtgattagatccaaaacttagttgcaaataatttttcggggaactatatgcaagcataggtccttcctaaatatttgctaatggaagcatgtgctaaataggatgcctaccagaagactgatacccagcagaatagctagacaggtaatttgacctctggctgggcccgtaggattcatcatccctccagacaagcacttggttgtggtaaagatctggctctggttggaaggctgtcccatcccactgagggtgattcaccagagcaacttaatcatctacggatcagaagctcaggttcatgtgagcagggtgggggttaagggaaagagagtctgagtaatgcttcacagtgggtgtggggacttgttataatagtaggcacgctgttgattaaagtacatgacagaagtaattgccagagatcccaaaccagccatcacctagcattagagatgtatctaatatcagacagaaagcctagtttcaactctgcagcagaggcctttgaaaagtctccagaagtaattggcacttaatcaatgcaatcattattacagcacatggctactgcagcttcaggccctcttgcaaccactgaactgcaaaagaggagactatgtctgtagaattttaccaccaacacaacatttgattcacaatctcagactagacaggagtgaacatattttcatatttatatattttagaaatacaggttcactgtcaataagaattcagtcttgtataaatgatggtataaacagggaggggcattttccctttacagaggcttaatcagcattaattttgagagataggaaagcaaaatctaccacaggctgttaagcatttgtttttcatctaatcttctcaaccctccattcaatatttgggggagtatgactgtttatcacttgctgagatatgcaaggtgcacatgctgcttataattaaggaacaaagaaatgttgactttgctcttggtcttgcttcataaagtgttaccactgggcatcaaattgggtgtttaaaggagaatatacctctcttggagagtagacacgatttttaggcctagatcgtctcttcttttccccgcaggagttcgtagttaactttccatcactctgtaaaaggcaattagaaaaaagaaaaagcccaagttcccctcttggcatcttgcagaagtctttcatgcataatggatgagaggaaatggggagaaagaaaagaaacatcctgaaatttaagcacccgtaaatgttttcatagatgttggtagtctatttcagtgtttttcaaaggatattcccagattacccacttcaggataagctgcattgttgacaatgcagattgccaggcctcaatattagacctgaatcagaatttatgggactaggaccctggaatctacattgttagcaagtgtctccagggattcctgtatacactgaaatggagcctactcatctatcttccatagtctaaacagtgctgtgctcagtatctccctccctacacctctcccttgttaatcaaatcaagtctctcatatttaaatgtctttttgtatgcagatggctctcaaatttatatccacagcccacacctcttccctaaaactccagaatcctataccctactgcctgattgacatttaataggcatattcaaaaacaaactcttgaattttctctccaaacttgtccttcttcatctccataaatagcaccatgattaccataaaaccttgaagtcactgttgactgcatccttggcatcttcctcactttctctcatattcatttccaatccatcagagtactgtcagctctactttcaaaatatgccccaaatcttcctctatctcgaagaccagataggaggctgctatcaaaatatgatgttttgattatataatatatattatattatagacttgatatattgtatactcacagctacacatttggcattagtggaaataaatgaaagatttcaatcaattcaaacaaggacacgtcgggatggaatagggtatcgtcagtaaagaaactgacaataatccagaaacgggctggtaagtctcatttatcagctaatgtacacacttctgatagcagcctcttatctggtcccactgcatgttttctgtatcagccagagttcatttgcagataacagaagccattctagctatttgaagcagaaagggattcaaaacagttgtggtagattgatgttacaaaaatccttcctgtttcacccacctttttgcaattgccacaactcccataaagagatgaagtctatttttctctccttgtaaatctgggctagccctcggtttaattctgaccaatggaaagaggcagaactgatgctgtgtcacttccagacctagccttaagaggctttgcggctcccactctcaccctcttagaagaaagcagccgtcctgtaaggaagctcaggctagattactgaatgatgagagaccataggagagagaggtctcagcctttcaaggcatccctgccaaaatcctagacatacgagtgagacaaagtagggccactgacagctgaatacacccacctgcctgtggagccaggcaggatcagcagaattgcccagccaaactaagtttttggggtgcttattacacagcaagagataactgaaatgtcactaaatttagggattgcaaaaccattggagggttggtggggcaggctgtaaatgtggcctccaggaatgactcacagaataacaccacagaactgccctgttagaagaatcgccgctcctaccatagtctgaaagctaaggatcaagaagccatcaaccactttctagcttcagaaacacactatcttagtcatgctctggacatcaggaagtctccacaagtctgttggcttcagaatcataccacagatcaattttagatagcaaaatggataaagtgctgtgaccaccttttccccactgaagtttgttctgaaatcaagacttatgcaaatgcatataactagcaaaaagtaaattatataaacccctagctgcaagagaatctttttagcttttttattttttatgtttattttttgtggcagggtcttgctctgttgcctaggctggaatgcattggtgcaaacatggctcactgcagccttgagcttctgggctcagaccttcctcccacctcagcctcccatgtagttgggaccacatgtgcatgtcaccatgccccgctaatttcttgattttttctagagactggggtctcactttgttgccctgaatggtctcgaactcctgggctcaagcaatcctcctgtcttggactcccaaagtgtgggattaacaggcatgagctaccgcacccagcccacttttagctttttggcctaggcactgtgggtaggcatagaagaaagaatttttttaaaaatgctttgttcactgcgtaacgctcacaatagtgttcacacaaaagagatgctcattaaatatttgttaaatgattgaactaaagtttgataaagcaaaggcataacttagaaatgactgtctctagttcgcccaaagtatgaaattctgtatgcctaaaactctctttcagtaattctcttttatgaatatattctggaatatcaagaaagatctaggattcaggatttttttcagcccaatatttaccatctttactataagtgtacaaccatcccaagtcagacaagctgagtctatttggtttttttttgtaataaattttaattggaaaagatgaatttgggagaatgggaagaaggttttgaagggcaagcccttcagtcatttctgcttcctatggctttggccaccatctcactttgagggcttgttcttcaggatactgacagcttgatttctctgggtaatgtcacacaaaggaaattagctcagtatgtcttctactgaattccatctgtagctcaatgtttgaaggtatttgtgaacatgactacagagcaattttgataagacaaggcaatgttccagtctctgagaatattttccccaaagaactattttttaaaataccactgaacagcctgaaaacccacccacacatgagcaatctcctgcaatatacagaaagcttttcaggtgtcacagccataatagcaggtggttcctttgggtagaaaaattatggcaagaatatagcgacagaaagcaaactgttttgatattctgggtacaactttccccaagtgaatcattcccatatgcctacttttaccacgggcgcctttccagaggaagtgatttgtgtgaacggaggtgtagagatgcattctggtgggtacacttcattggtgcccatatttagcagatccaattaatcgtcagctatttgtcaacccattcctctgtaagtctcaaaatgcaaaattcgaatatgaatttgatacctatttttgctttccacataacaaatacataatcttgttatgaagattcagtagtgctcttttaaggcaaggctgcttctgaaattccatatgaatagatttttaaatacaagcttataaagaaggctgagattagagcaatttgcaaaaggcagtcatttaattcactttttattatgaaatatttgagacatacaaatagcttaaagagcttatttactctgctgtaaacttttgttgcttgtaagataaaaatctggacttgtaaaaaagactttgtttctagatagaacagcaaagttgcaaagtaagagttttgcataatttttttctttctctatagtgtataagactagcatttttattgtttacagataaaccaaatctcccttactgaaaagggagatgttgttgtccccatctcaatttaaaacaaaaatcaactaagctctaataggaaaagatgtgtacaggaagattgctaatggaaaacttttatttttacattttatttgtatttaatttttaaatttttatttgttttatttatttgaatggaagacaactgcattgaaaaataaaaagaaccgggtacggtggctcatgcctgtaatcccagcactttgggaggccgaggtgggtggatcacttgaggtcaggagttcaagaccagctgggccaacatggtgaaacaccgtctctagtaaaaatacaaaaaaattagccgggcattgtggcatgtgcctgtaatcccagctactcaggaggctgaggcaggagaattgcttgaactcaggaggtggaggttgcagtgagctgagatcacgccactgcactccagcctgagcaacagaggaagactccatctcaaaaaaaaaaaaaaaaaaaaaaagaaaaggaaaaaaagaaaaagaaagcacagttattaagctacttaattctgggctttccaaatcttagagtggtgtcatttgctagctgggtgaccacgaacaagttctttaacctctctgtgcctcagtttcctgatctctatggggaggataggatccatcagttaggggttacatgtgaagcacttggaacaatgcctggcacacagtaagccctctatcaatggtaactcattttcttctttaccctcaactagaaagtcagctccacatgacagcagcaattctgtcttgcttagttctgcagcctcagcatctattttgcccatagtaggcactgaataaatattcgttgaactaactggttaatgaaaaataactgggctttgaggttgaaagtcaaaggaaatttctcctaagttttatagctagtgagggaaaaatggacagcagtttagagtcagggaggtagaagaaaaccctaaactaagatgagaagcctgattgaagttcagattcttccaactctctgggtattgcaatcaggattttatttcttaatttgctcatttatttatttacttattattattattttttgagacagggtctcattttgttacccaggctggaatgtagtggcacaatcacagctcactgcatccttgatgtcccagctcaagtgatccttccacctccgcctcctgagtagctggactacaggcacgcgccaccacacctggctaatttttaaaatttttgtagacactaggcctcactttgttgcccaggctggtctcaaactcctggcctcgggtgatcctctggcctcagcctctcaaagggttgggattacggacgtgagccaccatgcctggactctttcttaatttgtaaaatgggaatgatagctcccaaggttattctgaggagtaaatgacactgcatgtgaaagctcttaataaactgtaaaggaatatacaaaagcatgatatagttaatttctatctcagtaagtttttccattggatgacaataaagggattctttgagagtgttggaaaaaggaatctttagctaaagatttcggtactaaaaatattcaaccccagaggtaccacagacatagactaattttttccatctgtgcagtttagggtagatttggcatacgctcaataccaggcaagaaagaaactatggtttaggctgcttttaaagttaaaaaaaaaaaaggcagaaaaggaaactatttccttttataagcaggaatgttaaaatagggaaagctttcatcgagcaattcactactgaatcaaaactatttgatccatattctcacctacctcccctcactccgtatttgtgttgtggttagttgtcttctagatcatggtttatatatcatggtcacttcctcactaaagttaaacaatatagattattcttaaccagccacatgtgactcagaggtcaaaagagtgttctttttgggtaatctctctcaattgctaatacttaaggacctggttttcagaaccattgattatttaaaatgtatgtctttaagattaggctccacccaagatgcctcctcagaggctaagtttgaggttgagaaactagcttaaggagaaagataaagtagcagaaatgtcatggcgggtgagctgatgactcactgccccttccttgaactgcaagaatgacaaaatggaaaaggggaaaaaaaaaggcaatgccctactgcagactagaggctccatgaaacccaagaaattccgagaacttgaagaactacatgggttcttagggtaaaggcagtaagtttaatttccatggtcaaattgttaagtgcatcaaagaaaggacattaggaaagctaaacttgattatactttaccatcagagccatcatcctcaatctgatcattttattctcctgcttaaaaacttcaataactccacattgctactggaccaagtctaaacttacaatcgtatagtagaatattcttcataacatataaccttccttgttaacttcaccttgtaattaattctttttttaaaaaaaatttatttattttttaacttttgagacagggtctcactctgtcacgcaggctggagcggagtggtccaatcatggctcactgcagcctcagcctcctaggctcaagtgatcctcctgccccagcctcccaagtacctgggactacaagcctgtgccatcaccctgggcttatttttgtattttttggtagagatgggttcccactatcttgcccaggctggtctcaaactcctggcctcaagcaatccttcctcctcagcctcccaaagtgctggtattataggtgtgggtcaccatgcctggccgaattaatttttattacatgtcttggaaggtatgggggacaacttagaacttcccaaataagcaagatacttttaaattcccatcaatttgtttacactattccctctgcttaaaactctcatcccagctggcaactcctaactgcttcaaagcctgcctcaagtatcatttcttctcagtagctttctcaattcctatgctctcttgctcaactcccactctctcctgctactcagaatgattgctctttcatctctggagtcatagcactttaagcatgcctttgttaaatcacttaacccaatgaaataaatggactcacagagttctatcctttcctcaacttactgtgtactccctgaaggcaagtgtgagcatgtcattgtacaattcttgccacactattggagaataatacaggtgtgttgaattgaatgaaatattaaaagaggaccaaagaatagatggatcttctaggcctaggaattatactaggagtagaaggtgtatcctaaatccatgtatgtgattctgctttggtcttaccagagtgaatgtaatttgcttttatttaaaaacagtgttgacaggccatgcacagtggctcatgcctgtaatcccagcactttgggaggccaacgcgggagaccacctgaggttaggagttcgagaccagcctaaccaacatggagaaactccatctctactaaaaatacaaaatgagctgggtgtggtggtacgtgcctgtaatcccagctacttgggaggctgaggctggagaattgcttgaacctgggaggcggaggttgtggtgagccaagatcacaccattgcagtccagcctgggcaacaagagtgaaactgcatctaaaaaaaaaaaatcccaaaaacagtgttggattcacactcatgcgtgtaatcccaatactttgggaggccgaggctggtggatcacttgaggccaagagttcaagaccaggctggccaacatggcaaaactccttctactaaaactacaaaaattagccaggcatggtggtgcatgcctgtagtcccagctactcgggggtgctgaggcatgagaatcgcttgaaccctggaggtggaagttgcagtgagctgagatcatgtcactgcactccagcctgggtaacagagcgagaccctctctcaaaaacaaacaaacaaacaaacaaacaaacaaaaaaagccccacaaaccagtgtcatttagccaggtgtggtgcatgcctgtggtcctagctacaggggaggctgaggcaggaggattgcttgagtccaggacttcaaagctgcagtgagctatgatcacaccactgcactccagcctgggcaacaaagcgagaccctgtctctaaagaaaacaacaacaacaacaaaaaaccctcaaaccacactagtgtcatgaatatatttctttagataaaactttattaatcagctttctgtttagaattggctttcccataatccagttaaccaaaggtagttgagtaatttgaaatattccccagctggagtagaatcacatttggggcttgcttcaatcagtgcacctctgtcttgcttttgcttttcagagagaccctaggtcaaccatagcctttgaaggcatgagctgaacggaaaccagatgaactctattgaattttaaatttgccacatttcctagtctagtattaaacttttcttctctagttgagcaagttaaccaaagaagtatatatatattttttctcttatagattatgctcacctaagaacttgaggttacaacacacacacacacacacacacacacccaaaaaaccaaatcgcaaaacaaattattccatactcattccattggttcttttgatggccttctgtcagtgttaatggttggtgtgaaagatttttggaaacgttttccaggagggagtaatagcatttcctgaagcaccttttatcttggtttgtggcaaatgattctttcaatgccctcaggtcacttataccctaagaccctgcatgagtttattcaaccttcaaatcagtcacttctgccctcatctagggcacataacaatgtagttagttacccagcaggtatcgcggctaagtaagaccataaataaatcatatgagcaggagcttttggagtcagtcttctgtctgagcacctctaaccggttatgctaccttaaacaaattacttaacttctctctgtctcacctgatttaccagtttaaaaaaaaaggaataataatggtacctacctcataggtttgttgtgaggagttaaacgtctaaagcacttagaacagtgtctggcatatggtaagtattcaataaacattagccttatattctatactttaagtaccatttatttatatttttacatacaatatgtgggcataacaaaaaattaaaggaagaatggtcatttttagaaaaaactttatttacaaaaccacaactcagtctgctttggtattgacaaaatccctacaactgagatattaaagagatacatttattttagagttacataaaaccagaatccaacactaccctactttcctattcctttgtggctctgaatgcagctttaaaaaaaacaaaacaaagcaaagcaaagcaaaacaaaacagctctttataatgtacaatggcttaagcaaatcgctttagtttttttttctatttaagatttaggacagactactcgtctaaaattcactatttacagagaaggtcctagggaacaggataacttatttaggtttagctctcataatacaatatccataatggctttagaagaatgtaaataaataacattggtaaacagcgtatactgatattttctgacaaactcatttatctaacatcatgctgagcaatcaagaggattcctctatatattttaaattttaatttattctatttcctgattcacaaactcttgctccatgttaaagcagttatcaccaatagaacctatgagaaccagtgcccatggaaacctaacagcttgtttttttaatcccctattaaaactcggttgaacttgatatatgcatggttgaaatatgcgtgggtactaggcctttattcaggaatgtaaaattaatggtatctggtatcaagttgtaagaaaaactcccccagattgggaggtaactgagtgatatgtgaaagaatcttcccgtctgaatttaagaatacacctacactgggcagaaaaaggtgggggagaggaagtagaagtagaggaaaagcacaactccactggcttcaatcaaactgaggtaactaattagagacagaaaataaataaatcaacaaatgccccatttttgttttccaaaaaagatcactggcaactaacaattttaaagttgatccattaatatatttttaaatagaaaaaagtttgtatatcatatatatcataattccatttatctaatacactcctctgctgagatatttaacacatcttcatctgtactctcttctatctctggcaagttgccccgaagtaggacgtttacacctgaaaataaaaagtcataaaattctttaatgcttactactgttataactcagaacacaaattacgaaactttatatgttaatattcttatgtaaaccatagtgttagcagtaaaaagagtagctattgaagaatgtactgcaaataaaattacctaatattatccatctaggacataaactttatttatttattttgagagaaattctctctgtgttgcccaggctggagtgcctggcaggatcacggttcacaatcacagatcactgcagcctgaacctccagggctcaagtgatcctcctacctcagcctcccaagtcacttggactacaggcgtgtactaccacacatggctaattttattttgtagatacaggttcccactatgttgcccaggctagtctcaaactcctgggctcaagcaatcctctctccttgacctcccaaactgttgggattacaggcatgagccaccatgcctggcaaacacttttttttaaagggctaggacataaacattctttaaatccttttaagcaagggcttgaattctagaattttacagctcaaaaggctctcaggagtccatttactcaaactctgcctccagctgcattataacataatcactatacactgataattttctgatctattttaatgatgtttaagaatggagatctcacaagatccttttagattaaatgcctctttggagggttcagggagaagtcctgaataagtctcctcatcccttcaataagcagagaagtagctggtgccatttttctgattcagaaaaaaagcaagggttcggagccagttataatatgaactgcaatccttggtaccagtgggtttcagtccacaggcagagctttaaactgaactttagggccaggttgcagcagtcactataataaacaaaagaataatcaaaaacttcactgagaaagaatagtcagatttcatattgaagaatgaagcacaggtatacagtaaatgactaaacatacagtagaggataatgacaagtttattactctgggcatatattacattattagttaaaagcactaaatggaaaataactgacctctaggatagccaattaacttcacaagaaaagcaaatctttttttttttctttttgagtcggagtctcgctctattgcccaggctggagtcgagtggtgtaatcttggctcactgcaacctctgcctcccaggttcaagtgattctcgtgcctcagcctcccgagtagctgggactacaggcgaatgccaccatgcctgggtaatttttgtatttttagtagagatggggtttcaccacgttggtcagggtggtcttgaactcctgacctcaggtgatccccctcgcctcggcctcccaaagtgctgggattacagatgtgagccaccacacttggccagaaaaacaaatcttaagctgtccagttatcagtgtggacacaaagaggatccagcaattcaggatacccaccccatatacactgagatagcagccacatggcggaatggaatgagccaggatttggagatttggtttgaatccagtgttcaccactgctagtacaccatgcatggttttactacaaatgcatgcaacatagacaatatatattactgtttagtggatttaaattttgtatagaatgttattacactacatattgttttctaatttgctttttcactcgtcatgtttttgaggttaatccatgttaacttgtgtagatttcgttcatttatttttacttctggagagtattccattttgtgaatttttaaaaatgttgcaaatacagcccattgctcatcccttcctcagctgcccatcttgcataggtggttcaaggcgacatgcacagggatgtgtagtgtgacattgttgaaacagtagaaataattaactgtttaccttgactgagggagatactggaatctaatctggcaagaatttagcatgtatctgatgctggtagggatacagatgtgtatcttattattttctataatcttttcgtgtttgaattgtttataatagaaaacgctaccccatccccacccccaccctaagaatgaatggtgttctgctccaggtaaatgtcatggaagagctgacaggaagagctgtaaggaattgcgaggcaaaaatcaaagtgaaaattagaacccataaatgtaaatggagggctgaagccattttgactctgagggcatttgccaatttcaggaaatttgagctgaggtttcccaaggctcctccagaaagttctgggaaatcaggtctctaaatgaagactagcctagaaaacagacctccaggagtccttttcagtttaaacattatagaatttataaggcttgtctatgcattcctttgacactgctggttcaggtgattcaaggacagttgtggcgccattagaaacttgctttgataccaagcatctagaaaatcttgcttgaaatcacaatattagggttacaaagcagaagcttgatattcttggagtcagtactcagagacatgaagcagctcagcacaattggttcaaaggaggaaaaataaactaagagattggatctgacagaagcagcaccttcctttctctgttaagaagggaggaaggaaatcctgtgatacatgtttcttatggattagattcagtgcaaatggaagaatgcggggcttttatctttgaaaaattgaccaatattaaaaagtaaatcaaacttgaaaaatctccaccctgtgttttgaattctgtaaagcaggaaaaatactatcaaagcagaaacttcctttaatgtgtcccatgggcaacacaaatataaaactggagacttaaattaggagactgtatcccacttaggggagttcagataagtccttacatgaaaatggccttcttaacataccaaagttttaaattaagaccccataaatgatagattgagagccacagttgagtcccagataaaaaaatcaaatctacaaaaatctaagcataattggaggatttaaagacccttgacaacctagcttgcaattcgtgatcttttggtctgtgaaggcaaatcatatatttaaaaaatacatttaagttctaaaggagactaaaacatgcatttaggaacctaagaatgctagtgtcaacttagattgtcaagttacttaaagtcggctggcgaggtgtctcaggcctgtaatcccagccctttggaggccaaggtgggcagatcacttgaggacaggagttcgagaccagcctgggcaaaatggcaaaaactggtctctacgaaaaatacaaaaaattagacagggatggtggcacacacctgtggtcccacctattgagaaggctgagatggaagaatggcttgagcctgggaggtcgaggctgcagtgagccaagattgtgccactacactccagcctgggtgacagagcaagaccctgtctccaaaaaaaaaaaaaagttccttaaaatcaacttggtctgttgtgtaaatagatgttagacatggagaacatgtgtcttataacaaaactcaatggctccaggcaatataaaaagtattatataaatcccctttaaaaattggtactttggccggtgcagtggctcacacctgtaatcccagcactttgggaggctgaggtgggcggatcacctgaggtcaggaggtcgagaccagcctgggcaacatggcaaaaccccgtccctactaaaaatacaaaaattagccaggtgtagtggtgcgcacctataatcccagccactcagaaggctgaggcaggagaatcacttgaacccgggaggtggaggttgcggtgagccgagatcacgccactgctctccagcctgggtgacagaatgactccatctcaaaaaaaaaaaaagaaaaaaaaaggtacttcaggccaggcatggtgactcacgtctgtaatcccatgtaatcccagcactttgggaggctgaggcaggcggatcccctgaggtcaggtgttcaagaccagcctgaccaacatggtgaaaccctatctctactaaaaatacaaaaaaattagctgggcgtatgcctgtaatctcgctactcgggaggctgaggcacgagaatcgcttgaacccgggaggcagaggctgccatgagccaagatgacaccattgcacatcagcctgggaaacaagagtgaaactctgtctcaaaaaaaaaaaaaaaaaagaattagtatttcagtgcctcagcaccttaacacaaggaaaaagaattttttttttttaaaagaattggtagtgtactttcttactaaaatattttttttttttttttttttgagacaggatctcactctgttgcccaggctggagtgcagcggtgccacctcggcttactgcaacctccacctcctaggttcaaggggggtttcatcatattggccaggctggtctcgaacccctgacctcaagtgatcatctgtcttggcctcccaaagtgtgggattacaggtgtgagccaccatgcctggccttgctaaaataattagtataggcatacctcaattgtgctttagtttattgtacaccatagatactgggctttatataaatggaaggttttggcaatcctgcattgagtaagtctaacagcatatgcttaccttgtgtctgttacattttcataattctctcaatatttcaacctttttcattattattatatatattatggtgatctgtgatctttgatgttactgttataattgtttcagggtgctatgaaccacacccacttaagaccacacccacttaagactgcaaacttaatcgataaatattttgtgtgttctgactgctccactgaccagctgttctctctctctttcctggggcctccctatttcctaagatacaacaatattgaaattgggccagttaatatccctacaatgacctctaagtgttcaagtgaaagagagtggcatgtctctcactgtaaatcaaaagctagaaatgattaagcatagtgaggaagacatattgaaagctgagacaggctgaaagttgggccttttatgcccaattgttagccaacttgtgactgcaaagaaaagttcttaaaggacataagaagtgctactccagtgaaaacaagaataaaaaagtgaaatagccttattgctgatatggagaaagttttagtgacctagatagaggattaaaccagccatgatattctcttaagcgaaaacctaatccagagctaggtcttaactctctgcaattctatgaagggcaagaaagttgaggaaactgtagaagaaagtttgaagctagcagaggttggtttataaagtttaaggaaagaagccatttctataacatacaagttcaggtgaagcaaaaagtgcagacgtagaagctgcagcaagttatccagaagatctagctaagattatggatgaaggtggctacactaaacaacagatttttcttttcttttctttttttttttttgagatggagtttcacttttgttgcccaggctggagtgcaatggcgtgatcttggctcaccgcaacctccgcctcccgggttcaagccattctcctgccttagcctcccaagtagctgggattataggcatgcgccaccatgcccagctaattttgtatttttagtagagacggggtttctccatgttggtcaggctggtctcgaactcccaacctcaggtgatctgcccgcttcggcctcccaaactgctgggattacaggcgtgagccaccgcgcccggcctcttattcctttttttttttcagatggagtttcactcttggtgcaatggtgcgatctcggctcacttcaaactccacctcctgggttcaagtgattcttctgcctcagtcccccaagtagctgggcatgtaccaccacgcccagctaattttttatttttagtagaggcagagttctactatattggtcaggctggtcttaaactcctgacctcaggtgatccatccacctcggcctcccaaagtcctgggattataggcgtgaaccactgcatccggcagagatttttaatatacacaaaacagccttctattggaaggagatgccatctaggactttcatagctagagaggagaagtaatacttggcttcaaagcttcaaaggacaggctgaatctcttgttagaggataatgcagctggtgactttaagttgaatccaatgctcatttactgttccgaaatttctagggttcttaggaattatgccaaatatactttgcctgtgcgctgtcaatgaaacaacaaagcctggacgacagcaaatctgtttacagcatgttttactaactattttaagcccattgttaagacctactgctcagaaaaatccctttgaaaatattactgttcattgacaatgcacctagtcactcaagagctctgatggcattgtacaaggagataaatattgctttaatgccttaacataacatctatttggcagcccatggatcaagaagtaatttaatctttcaagtcttattatttaagagatagatttcataaggctatagctgccatagatagtaattcttctgatggatctgggcaaagtacattgaaaacctggaaaagcacattcctgattcatgggaggaggtcaaaatatcagtcttaacaggagtttgaaagaagttgattccaaccctcatgggtaactttgagaggttttagacttcagtggaggaagtaactgcagatgtggtagaaatagcaagaaaactacacttagaaatggagcctgaagacgtgactgcattgctgcaatctcatgatgaaactttaatggatgaagagttgctttttatggatgagcaaagaaaatggtttcttgaggtgaaatctactcttgatgaagatgctgtaaatattgttgaaatgaaaacaaaggatttagaatattacataaacatagttggtaaagtagtaacagaatttgagaggattgactccaattttgaaagaggttctactatgtgtaaaattctatcaaatggcatcacatgctacagagaaatcttttgtgaaaggaagagtcaatccatgcggcaaacctcattgttgtcttattttaagaaactgccacagccatcctaacctccagcaaccaccaccctgatcagtttgcagtcatcaacatcaaggcaagaccctccaccagcaaaaagattatgacttgctgaaggttcagatgatcattagcagtttttagcaataaagcatttttttttttcttttttgagacagggtctcatattgttgcccaggctgaaatgcactggcatgatcacagctcactgcagcctctacctcccaaattcaagtgatcctcccacctcagcctcctgggtagctgggacgatagtatgccccacgatgcctggataatttttgtattttttttgtagagatgaggtctcagcatgctgcccaggctggtctcaaactcctgggctcaagtgatcctcccgccttggactaccaaagtgctgggattacaggcatgagccactgctctcggccgaataagtattttttgattaaggtatgcacattgttttttaaatgtcctgctattgcacacttaatagactacaatatattgtaaacataacttttatacacactgggaaaccaaaaaattgtgtgacttgctttaattgtgatatttgcttgctttattatggtggtctggaattgaacctacaatatctccacttgtgcctgtacaacatactttatactttggtgtcaaatatttcccttgactaaaattctgtcataacgtattaacatagatgtcgaaatgtctgtttttattctgaagcatcaccaaatacagaggttacttagtcctcctcctctcaactcccattgccctaggcctggcctctccctttcttacacacacacacagacacacacatgcattagactatcaaatctaaaatcttcaaaaattctctggagtcagaatatgtatcaaggcagcagttaagagcaattataatattcattttaaaagaccaagaaattcagccaagtttgaggccttaagtacaaggatgaacatagaaatgacaatgaattttgcctaatagttttcataagtgaatgtctgggaaaaaagaattgaagtttcactctagctaatccagctaagaagatctaaaaggaatcctgaaatgatctattgggaattttactcaggtattgatagagaaatgttacaggaatgtccaagtcaattgtttcttacctgtggagtctagtctgttaatatcataaactgcctggctgtgaaacatccagaagtgtctgttgttgcaggaaagaagacaggaactacatggaacaatcacatgataaactacaatgttcccactagaaaagaaagtaaatgttactagataccatgtaataactagccagataagtcttttcatattgcttatataaatagaccatataatttagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctagaataactttttttctctcagtactttaggatgttgccacttcgacgctttgtcattgacatatctttcctgtttttgtaaacttggcataaagtgggtttcctgtacttgttatatgatttttggattgtgtattcaaattaaaagtattaaattaaaattaaaatggcctgggtgaggtggctcacacctgtaatcccagcactttgggaaggggaggcagaggatcgcttgagacccagagttggagaccaccctgggcaagatagcaagaccctgtgtgtgtgtgtgtgtgtgtgtgtgtgtgtgtgtacacataaatatgtatatatattatatgtatgtatgtatatataagtcctacagtcaccttaagttccaccaacagtgcgcttaaggtaaaatgtgcccaacctgaggctcaaacctacctgctggcacgcaatttgtgtttgtgcgacaatctcaacagcatttgctttttctagcatagtggttttcctgttttcctcacatgtgaatgtcttcagtgcaaaacctgtcagaattcatttcctttgctaaaatgttttaaaataactcttacttcaagtaagtgcattaaaaataaacttctcagttgcatccctggaatccatggaaagtccaggagagacaatcaagtgctacaggatcaagcccaaacagaacaggactaggcatggcttccccactaggagccaggccaaagtcatctcctttggtctccaatggaggccagaactcggttcacctgcaacgggaggacctggcccagaagaggtggccttcatcttcatggtgccttcagataggaaatctaggatttcttttcttctctttcatctacttccaactctccctatttatttatttatttatttatttgagacagagtcttgctgtgttgcccaggctagagtgcagcggggcagtctcagctcactgcacctccgcctcctgggttctagattctcctgcctcagcctcctgagtagctgggattacaggcgcccgtcaccgcgcccggctacttgttgtatttttagtagagacagggcttcaccatcttggacaggctggtctcgaactcgtgacctcgtgatccacccacctcggcctcccaaagtgctgggattacaagcgtgagccaccgcatctggccctccctttctatttcttcaagacctttttctgatccctcctgcgcaggacctaaacgggcggtgcccttacccactggtccctccctgcctgctgtcttcggagccctagctcacccggaacgttactgcccgccggtgacagcgagaggaccaaagagggcagtgggtgcggtgggaaccacagagtcaccgcgcacctgcgcctcgcgggctcctcgcaaattgaataaacgccccctgaagcttctcttcaagtcacagggaaggggaaggtggctgccgacccggcgggagaagccggccctgcccctggtccttgaagacaggtttggccaggctgattttgactggtaggcccaaagaaaagcctcaagggcagaccaaactccgacaggctccgagattaaggctttcaaacgtctgatcgttttcagcttggtcagtaaaatcgatctcgcctttatcaggagattcctttgccaaagttcagagagctggggttccagctgcttgccacacagaaaaccaatcactgagacggttattgccaaggaagaggctttaatagggtgctgcagcggaggagatgagaactcagtctcaaatccatctccctgaccaaccaaaactagaggcttagatggcagggaaagaatgtgacaatgtgtaagaaaacaggaactagaccaggcgcggtggctcacgcctgtaatcccagcactttgggaggccgaggcgggcggatcacgaggtcaggagatcgagaccatcctggctaacaaggtgaaaccccgtctctactagaaatacgaaaagaaattagccgggcttggtggcgggcgcctgtagtcccagctactcgggaggctgaggcaggagaatggcgtgaacccgggaggcggagcttgcagtgagccaagatagcgccactgcactccagcctgggaggcagagggagactctgtctcaaaaagaaaaaaaaagaaaaaagaaaagaaagaaaacaggaactagggaggggcaaggaagcaatcaggatgaatgaggggtccggcatctcattgtctgggtgactttcagttctttgatatcttttttgagaggcctgaaggaaggaactcaaataaaacaaatatcgagtttcaaactttcagatcagaagggtccatttctatgtttatccaaaaatctacgtattggactattgggtgggtttcagaccaagaaagagtgtgcatatcaaagtctgcggttaaccaaagagaaaacataattttccgaccaataggatgtatgggggtcaaagaacgaccagcctacagtactgtttattggcctgagcatacggaaggatgaagttgcaccagcgaaatgggattaagctgcaggtgcgggctgggcgcggtagctcacacctgtaatcccagcactctgggaggctgaggtgggtggatcacttgagatcaggggtttgagaccagcctgaccaacatggtgaaacctcgtctctaataaaaatacaaaaattagccgggcttcatggcgggcacctgtagtcccagctactagggaggccgaggcaggagaattgcttgaacccgggagatggaggttttaacgagccgaaattgcgccactgccctccagcccgagcaacagaccgagaccccttctcaagcaaaaataaaaacaaaaagctgcaggtggaaaaaaaagtctggattttggttcagagcccctggggccttcctcagtagttttctctttctttgaaaaaggaagcctgtctcagtctctgcatctctctgagtccttttggagattgaggatggtgaggtctcagtgcttggcccccttctaactctgggtacctcccctcccgtggtcaaactggtccagtgcacaggccccagctccgacgaccatctcccccctaccctttgctcccagcaaaggccatttctaggtcagtcgtgaggtacagccaggacagggcagctcgctccgagatttttggctctcgaaggccttgagcgctgtggttctgcagaacgctgtctgcctcttgtggaggaactgacacccgctggagaaagtgtggagggaagcgagggctgcacctgcacgcaggatctgaggcaagcggctgttcccagctctcagtgcaaaagacatttgtcatctgagaggctggactcagttattataattttcaattttgtcaataaaaaccgaatggaaatttgttttcttacttgtagaaacctcctcacaagacctcccatcttacattccagggagaattagcagggtattccgccaagacataggttagactgcggttctgatctgcaggcctcgatgccctgcgccagggcaccagggcatgggcaaagccctccccctacacaaagcaagggtgttatgtctacaaccgaacggggacactaagagcccccaacatgcacggttttcattccaaagaaaaccaccagttctgagtacaacttccacctggctctattaactgagtacacgtttccccagcacagaaatcctacaaactcccgtgaatgctgtggtgaaaagcaggagctgccagggcaagatggatcgcacctgtaatcccagcacttcagaaggctgggcggaccacttgagcccaggagttggagcccagcctgagcagaatggtgaaaccgctacgaaaaaagaaaaagaaaggaaagagaaagaaaagaaaagaaaaaaaaagagaaaaaactagccgggtgtggtggcgtgtggttgtcctactcgggagcctgagatgggaagatcgcgccacttctccagcctggacggtacagcgagacttgtcttagggagggggggaaaaaaacaacaaaaaaaccagaggctaagaggtaactccgaggatgacagaaaacaccagagtttttaagagatgttagaagccctgggagcactgaacaaaccagaaagctcccgacccttgatccctgagctccacctagcaagtaccgcggcagctaacctgggagaacaccccaaccaacagagactgaaattcgcctcccaagagagtaagtggatagttctaagctgtccccaaacatggcctcacaaacgaaaactaaccgttgcgaacggaaacaactgaccggacagaacacagccacaaaacacgagcccgcacactgaattacaaaaacacttacggctcacctactattcgcaccacaaaagcaccagaggaaagcgcgaacgcagtcccccactaccacaaattatgcagtcgagtttcccacgtttggggaaatcgcagaggtcagcacatccggaacacaatggataagcctcgccctgagaaaaaccaccttcgtttgataatagtatctcccctgccaggtaagtatgagcttttgcacctccgccccgccacagcctcacacgcttcaccctttacacgcacggtcacttgccccgcgcacccccccccccccccccagccctcctagccctgacacacagctgggactctcaggtccgaccagcggtcctgaacccactcccactgcacgggaactccttagtggcgaagcagcagcccctgcgctgcctcatctacatagaaatcgccctatccgtgatgtcaccgacagcgcctttcccagtccccgtctgctcttccgccccaccctccgccgactcagccgatcaacccgctgccggagctggcgaaggaagtgacgtctgtctctttctccttttcctcctgccattgtcctttggggaggtgcgcagagaccccgcgtctggtctccccctaagactgtggtacttgatctgtgtcctgcagagaacccttctggtggccaacaggaagcttttgcacccttcttcagataatgtcttttaatgcgcagacttgaacgtttaggattacaaggaaaaccggttcctttcaaacctgtttatctttgtgatgtagcattccgcttcaagttgaaagccgttcaatgtcagagagaaaacatatctatgaaaccagagaggctgctcagatgggttgcaaactagccatccttactggttttaccactagaagtgttacaaagacagttgtccaattttatgaatcttgaagggttttttgttgttgttgttatttcaaatacagtgtaatacaaaaatatgtggcccccgcagagacgattggacactctcaggcatggtgatggagtttgtcatctcttccacggccatctcagaaccttagtgcttacctcatattagtattttatattctccaaagacacaaaaataatcccaatttgacaaaacaaacaagcaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacatgaaatggaggggtctcccttggagaccataaagtctgtgacatggtggccagttgggtcactggaaaacatggcaaaatattgaaaatgagggattaggtgagagtgtagcaactgaacactaaatgcttgatccaggtgccattccctggatactgacaggtaatactggaaaaagggggtgggcacagtggctcatgcctgtaatcccagcactccctcaggaggctggcagattgcctgagtccaggagtttgagaccagcctgggaaacatggtgaaaccccatctctacaaaaaaaaaaaaaaaaattagccaggcatggtggtgagcacctgtggcccagctactcaggaggctgaggtgggaggattacttgagcctgggaggtgaaggttgcagtgacccaagcttacaacactgcacttcagcctggatgacagaggaatgggccttcactagacactgaacctgctggcaacttgatcttggactgaccatcctccataactgtgagcaataaatttttgttgtttataagttactcactctgtggtattttgttatagcagcacaactggattaggacatcaacctgaccttaagaaatcatctcaattcagtcttggctctggtgggaaacaagggacacactcggatgtgtgatttaaagagagttgtgtttttttttttttttttttttttgagatggagtctcgctctgctgcccaggctggagtgcagtggtgccatctcggctcactgcaagctccgcctcccaggttcacgccattctcctgcctcagcctcccgagtagctgggactacaggcgcccgctaccacacccggctaattttttgtatttttagtagagagcgggtttcaccacgttggccaggatggtctcgatctcttgacctcccaaagtgctggtattacaggcgtgagccaccgcgcctggcctaaagagagttttatgaagagaatatttataaatataatatggacaggatcaaaacaacccaaccaaggactgagaggcgctcagaatctggaatcagcagagaagttgtattgcctctaggactggattgttgtataagtctgttcaggttgccataacaacctggacaggaccgtagtcctgtccagtgatcctccccaagacaaccgttctctctagtaactatggttttcctttctcatttcaattgtcacctcaattgactgaaatgtgaacaccaactcccgcacttaaatgttgaagccctaacacctactgtgatgatttatgcagctggggcctttgagaggtaatcaggattaaaagaggttatgagagtggtgtcctcatgctgagattaatgccattacaagaagagagacactagaaagcttgcttgtccgccttccccctggtgcacgaagaaatggtcacatgggcacacagtgaatctacagccacttacaggccataggaagagaccttagaaagaaatccactttgctaccacctttatcttggacttcccaacttccagaagtgtgagaaatacacttctatagtttaagccacttggtgtatggtatcttgttatggcaacctgaacagacttatacaacaattaagttgcctttccactgatggacttagacacaatctctttcccaaaaaagagctatatttagctacttttcttttgcatattgttccatttgcagccacactatttgtcttcccccacaccacttctatcaccaggaatccattttccttgttttctttttaatatcgggagcctctgctcactgcactgcatagtccttggggctttttttaaactttatttttaacaatcatttgagcagaaagtagccaattcagttctttaatttcccattttattcttggtttgaaactgacctgattgtgtcccttttgttatgaccagttacttagaagccatacagcccacaaggtacccttgggtataaatccaacttcttcattttaatggtgagaaatcaaaagcccacgtttcctgatttctagcccagcactggaactgttttcatggcatgtcaattcatcatacattttaatagtgatattttatatttgcataattttattgcctttgcaatgggctttcacatctatcttctcatgtgtatatagtttaaaggccatttttacccactatctcctaatcatatcgaccacagcctcaggaaatgtctgctctattatttcacttgcctgtctgggttcttgggcaacagcatagaatcctgtactgtgttttccctcacgctttctcactctctgcagaacaaatttttgttacatgccttattatcatggtaatattggccttcagtcctgtatagaagcattaaaaatgtgcataatgtatatccttttaaaatgttatcctaagaagcatcttttggagttaaggagagttagatgaataaagaaagaatacagtttctcctaaacaaacccactaagaaaatcatggaaagaattatgacaactatgaaaatgaaggaggtatactttgtcaacaaaagcaaaataaccaagctactcttagacataatctcacattatctttctgtagtgctctagcattttctaagccttttcacacactgttatctctttttttctttctccttctagaaattaattatgacttttcctttcaaaaatgaaggactttttttttttttttactcttttcattttttcctgagaccatatgtcaaagggaatgtgaggaacaactttggtgtggtaatagccaaatttctccaggtctgctcctcaagcttgcaaagtcaagactggcagaagtggtgatttttacctgggtatcctgagaaccttgcacagtccttatcacatgcaggtgttcagagtgtgcaaataaatgaagaaatgtgagattgtgatgatattttcatggcatgctttttttccacacttcctcatgcagcccaacatcctctacactgtgttgttctacccgtttaagtgatttaccacttctccattaagccaacttaaaccatgttgccttcaactcaacattgattgatccccaatacagtcctgtagggaggcaagaaaacttacaaacgaagtggtaaagaaagagagagattaagcaatttgccccaaatctcataaccactaggtgataaatcttcaactagaactcaaatatctggctgagaattcagtgctcttttcatttaaatcacattgcttcataaaaatagatctgcaggaagaataaaaatgtccaaagtgcaatgagagagaagataatatggagacagacatattgcacagaaagcatttgaccatatgtctgcctgatccccttcatgtgtcttgttcataacttactttactcgggcagcaggagatagcataacaactgtcagagtgaatttaggccacagttttgtgttgctgaatgtgttgagtcatttcccttagttcacatttctacctaactttatcttttaagtcatcatcatgcctttaatctcttatttattttgactgttgagattttgtagccattatccaaataaaacatttattttcactcgtgagtccctaatccttcctcaatggaattagctatttatttgatgcaatagctagaccagtagggttaaaaatgcttttataaagacattaatagctgggtatggtgatatgcacctagggaggctatggcaggaagatcacttgagtccatgagtttgaggccaatgccttcgcaacatagtgagaccctgtctttaaagtaaaaatttaaaaattaaaagaaaagacatttaaaaaggctgtttaccaaaatgatggttaattgacagaaaatagaaactgaaactagaaatcattgccatcagctttctctaatgtgtacttgatccttttctccctgtgatggaagtctaaagtctttttgtttttttcttaatccactactgttcaaatgagaataaacagccaaatgactgaattagttggtagacataattcctagtcttcaattatttttattttcttttgtaatacagtcattattttttcagacttctataatattgcatttaaccaatccccaaatagggaaatgttatgtaatttttctattatttacagttccttgattataatcttttatttgaaaagattatatatttatataaaaacccagtttctttcttacatataaatattattagtagtctaaaaatgtcactctcaataaacaggatgagtcaacttgaggactagagaatcaggtagtcaacatcagagaactggtttagcaaacagaaggggcctatccagatagagagaagtcaggcagggctgtgctgtgaaaatattagagaagcttgatgggaggcctaatatagtttgtctttacacctgtatattttgcttcttgcatctgcttcaatgccctctgtcatttattataactagatttattgttccaatagatttgtactacagtcagaacaaacaaatcactggatccagcagaagccttagatatatgacataacagagatttgcacaaagatttgccccattgccttctcgaatttctcttatcatcaatccatctagctggagctctctgaaggtcatcagaggtcagtataattttaataagattttaactgaaggatagccttgatgttcagtgaccttcagacatgtttataatcgagaagccactccccctgttgaatgataacctcttccatgaattaccaaaccaatgttgctcacattctgattaaccattgattcccataaacccagcttcccccaacactgatgatctaaataacctgaattatttgcattgccttatcaattccatctcatttcctgtcttggtggttttgctcacactgcttctatgtggaatgtccgtatgtagccactcgagtttccacttcatcgttccatcatctgtagtctctatacactatccatcatcaggactaatgtgagctgactttcctccaaaaagctttccctgaacttatcctgaaataacgtttttctctgctaacttaccatttgtcacgttagtatacagcttctctaactgtcatgaaatgaaataaatgggaagaagatgaaacttgaaaagaaatctgcttcttaaggcaggccctgggggaatagccctggctggaggtaatgtaaggtctagatggtgtttttagaatctgaagactgcaacaccaaacacaagtataagcctaggcaagctgtcagtgcagggcctaaaattaggtatttcaacaagtggatgaatcaatttggggaattgtattagtaaacagaggaagcccgtccagtaaaagggagagtaagcagggatgcaatttaaaactattgaggaaaaaatggctaagaaatagtaaaattaacacatggcctaaaatattaagaaattaagcctgttacagaattactgacctggctagtatataggagcattaacaacacaaaaacagattaggtcgggattagcagtgggggtgaaataatcttcagggctgaactactgagctagaaatatttaaatcctccttgcagatgagaactatagaggacaatttattggttcagcatgaatttctggtcttctgttaagaaatacgctctttcattgaaagtgaacattgaggcagtaaactccaaatacagctgcaggtactatctcctgctgatttgtgtgtacagagcatgaaagaaaggctcagaaacaaaagcatgttggaaaaataagcagaaggaggcatttacttgcaaagaaatgtgaggaagtcattcttcaaaagaactgcccaaaaaattaaaaaaatagaactttttaagacaaacaatattatgaagactatagggtttatattaatctcttcatggcagaaaacagcaattttatcatggttattgtattcagaaagttcatgacatatcttcagacaataaacagctttgtaaagtcaaggataaagtgattttcattaaggagttagcaactctcaggaaatgctcaaggttttattcatttggaggactgcaggtagacagagagacccttttattgtttctttatgtcagagtgcagagtttttttttctctgtttcttcagcagtgggacatgatgaatgggctgacaatggtgtcaggccccgatgtcactttggtttttacacttcatcttgcggtcatgtttccttctctacaggacatgtttgtctacctccatttgctgaacaatgttcttaatcagtactattgattttacattttaatttgatccattttatttgcacagatctaagaagtgttgattaatatttaatgacctcctagtatttttttgatgaaacaataaactaaggctcacaagtttacgtctttctatagatttataaagcccttgtggattaaatttacttttacatgtttaacagctcagtttagagcagaccaaaccagtccgttcacctctacctgatttcatctgcagtatttataatgcaaatgtatcctttttaataaaagatatccaatgtctcggtgtccctgctctgccaagaaaggacattctttcttacctccaagcctgagattgcatagtccatagagcaagcaccagatttgtttcctagaaggatgttataggcatcgcttctgcgtgaaaaacatagaaattattcttattactggatttgtcttgtctaattaaattgaatttgtagcacagctataaattttttattaaaaaattgattcttcctggctgggcaaggtggctcatgcctgtaatcccagcattttgaaaggctgaggccggcagatcacctgaggtcaggagtttaagaccagccaggccaacatggtgaaaccccgtctctataaaaatacaaatagtagcctagcatgatggtgggtgcctgtaatcccagctacctgggaggctgaggtgggagaagtgcttgagcccaagattgagaggttgcagtgagttgagatcacgtcattgcactccagcctgggcaacagagcaagactccatctcaaaaaaaaaaaaaaaatttctaattagtaatatattcaggtagaagggaggacaaattcttattgaaccaatataaataactacatagtcacaaaaagtaaatgtttttattaaagaaactttgtgcaagatttaaccaatattgctaattaagggtatgttaatagacaaaaccaaatattgtatgtcacaattctttacaaaataattatttgtatgtttttcttggcaacttattagctttgtttttatattaagaatttctgcaaggtattttttccctcaacactaagaattcagagtgttttatttagtttttacaaatttaataatttgtaaatttaattggagattaaaggtagattaagaagaaagaaaatgggttgttctcatgttcattaaagtagaaaattaaactaacctcaattaaattgccttactgaggccctttaatcctaaataacaacctcttgtcgtgctggtcttgagttaagcagtctactttcatgaattcatccgcttctacattgtgagtgtcttggaactcctgactcatttacttcgtatagttggaatattgtctgtggggacaaggtcagcctattcttggaggcctatatccatgagtcaatttcctgtggtatcaatagtatcaacagtgtctgctaccgttattactggagctcttttgatatttcttccagatgactcaaattctgattggcgctttgtagagaggcctttaggtatgcttaaagggaaaggagggctgggcacagtggctcatgtctgtaatcccaacactttaggaggctgaggcagacagatcacttgaggtctggagtttgagaccagcctggccaacatggtgaaaccctgtgtctactgaaaatggaaaaattagccatgcatggtggcgggcacctgaatatagctactcgggaggctgaggtaggaggacagcttgaacccgagaggtagagtttgcagtgagctgaggtcataccactgcactccagcctgggcaacagagcgagattccatcttaaaaaaaaaaaaaaaaaaaaagcagcggggatagggggaggagatgttgctaataataaaactgtaaagtttggttaattttttgccatagcaaacgacatcacaatgggggacagtggcattctctgttgaggtgtaatacatactcatctaatgaaattttaatcagtgattaccgtaaaagacagaacacatgaagaacaattagtgcatcccgatacctctccagggcctttaattttccccacaaagtagatattattatttgtcaccaactgataagtttactttttttaatcagttggttgacatttattgcaccagtctttgtacatgaacataaatatgcctgaatccaacctgagaagtgcacaattattgtaacatagccacagtaatcatacataattattgcatttaattaatttaagatgattttattgctattttctcagaatatggccttgaaaaacacagcagcttccactatattgagcatagttttgagccaattaaatatctggagaatgcaaaacattacctttatttctaatatatcttcatgttaagagctaggaggaggatctctggagtttcccagcagccatctgagaaacccagagatactgtattcataaataacatctcagtagttttactattttggatttgagggttaaatttggggaatatggtatcaaaaacagtgtcacaggtgggggctgcagatgtgaagggcctgctatcaatcaggtgaccctggatggactacccactcgctgtgtcagtccaggatcccagctgtagtgggttcctctctgctacagcacatgtttctaaagggcaagaatctgggctcccaataactgacctctgtctcctccatcctggcttgtcatgatagacccgaaccaccctcccattgaatttgggcccttgtggctcatagccacaagggaaattgggagctcacatgtgaaaggcagaattaagttaacgcaccttcttccaaagtcttacgtttgtttgtagcccaggtgcccctgtttccagcaggagtattagcagtaccaggcagccactccccagagtttgtgtttctgagctttcccatcatcagttaattggaaatttcaggaactgtccctgccttacaatgcctgctctgatctacaggtcttttggagacagacagcaggtgatggggcatgccaaagagataaaaatgtcttctgataatcaggggtcagcagatgagtatgaaagctaattatccccactactcagggaatttagaggcttccccttttgtctttgtaggaatagcagactttctgactgtaatgtccaaagttctttacaagttgaagtacagaagagatcagaaaatgtcttacgcacatgagagttgttatccaaagatttgtcataggagcagcgactctaggtgttctctattctatttagaagaattacattagattttgattcctcaatgtggccaagaaatagagctacttgctgggagcaagaaagataacatgacttctgaaaactatttattatgaaaaatgaattttcattatgtagcaaattacactgcagaagtattacaaagaattctcatagacatggtatattaaatctcaaatcaataatcatacatagtcaattaaaaatatctttgttgatatctttcagaacctgggaaataattttctgactttcaaattttttagtttctattcagtggcagaaaatctatattgtgccaaaccagtctgaaaattagtagttgattatatgctggacacagaaaaattttctataacctgttaaatgcaacactccattcattgcttaattctccccaaatagcataaggtaattaaggcttttgtaaacttttttctttttttagaacagcctacagtgacagaggagaatggttatattgttaattaaagctggttcatcactcatgtggtaaacctgactcacatggaaacttaactattttatcacaaagataaatgtttatcatttaaatatgtatgtattcacttttatacttcttgaaaggatttctaggagtacaaagtaaactactataaatctcttttctcccggatggcaatattgctgtgggtgagaaacaatttagtccaggagagctatatctaatccggtaggacactgtggagaatacaagtgttaaatttttgctaaaaaactaatatatggccgggagtggtggctcacgcctgtaatcccaacacttcgggaggccgaggagggtggatcacctgaggtcaggggttcgagaccagcctggccaacatggtgaaatcccatttctactaaaaatacaaaaattagccaggcatggtggcaggcgcctgtaatcccagctactcaggaggctgaggcaggagaatcactggaacccgggaggcagaggctgcagtgagccaagatggcgccattgcactccagcctgagggacaagagcaagactttgtctcaaaaaaaaaaaaaaggctaatatatggagattgatttattattttatcaaaaaggtgacccaaatactaatatgacttttttgagaccatccatttaacaaattgactaaaagactcaaaagttcttttatgttttatgcccaaactaattaacattgagtaaagttagtccaaaaattataaacgttttattgctcatttaaactcattatttgcagctattataagctatagcaaatgaagtttacttccctcagatattctacaattattgtatgcccttaaatttgtattttaaaattcagttttatattctagcaaaactctacaatttgccttttagacaaaattactctctttgccttgataagcaaaaacacattaattatattgcatgcacttttctaaatactcaaactgacttaatttcttaaagtagtataaaagaacatgtgcattaatcagaactaagggtacttttacatactgttcattctcctacttgatagccactctataatgtgtaaaaatatgcagcaaggatatgttaaaaattttatgagacttatccaaagatttttcactaattatctcaatgaaatattagccaagctcataaagctaactagtatgttaaaattcattttaaactgacacactgcagagaatttatactaaaatataaaaatttacatgaaaattgtgttacatatgaaatttgaattttttaccaggtagggtatgtgtggttttacctatacagtataattatttgtagccccatctcaagttacaggaacaaatgttttaaaaaatactagtttaataattcaattcagctgaaccttaaatcgagtaggggacatctagaaagctctggtaagttaaaatattttataaaccagaaaaatatgctaacattaattctaagattgtgataaaatcagagaaaaaacataattaatttaaaccaaaattatcaaaccatatacatttatccaaggatttcccatgattaaaaatattactgaactttacttcagtcaaatttttgaaacgcttcaattttgttctgaagcactgaagtcctttgcgttatgcgattctcttacccgcctgccttcccttgcttctcgccttctgacatagcaacaaagtccattaattcacctcagaactaaacctctctatagattttttcttctgagctgcagttcagcaagttacctgtgctagtatacataagccaaggaaaacagaagctccattaaacttaagaaattgtttaacctaactcattaattttctccagagataggaaaatgtacaataatttgttcagaagatatttacatacatacaacaagaagtcattatcaaattcggagccagtgatgattttctccctgctttattgtagactttcatatgctatttatttatagtccttatccagtcagattatagattatggtagagacgtaatttttgaggttgagtaatactttactgttgatgtatagaatattcctcacaacttattttaactcatttttatatttctatgagattttccttgtttggggttttttgtttgtttgagaaaagggctagagaaatttaaatgcttgaaaacctttagagttttcagaagcacccagaacttcaaagaaacacaaagctattctcattaatgctttcttaagacaaataaagcaaagccctaccaacagttagagctctccatttttcaagctatgcaagattgtctccaatagttatggcttcagcagtggttcaacttgagtgtgcatcagaaccacctgcaaagcctaattaaacggattccttggctcacttggcagtatatgactcagtaggtaagatttgagaatttgcatatctaacaagttgccgggtaatactgataccgatgtctagggactatgagaatcactaacctagagtgtttaaaaaatgaccaatttctgtgcccaattatctgccaaagtttcctaagagaaggaaaacaacaacaaacaaacaaaccaaaacagagagaaactgagagaaacagccacaactggaaactagtaacacaaaaacaaaccattgtaaaagctaattaacttattttcataccaatggggaaagatttttatttcattttggacccacaaaaagctttaggagttttttcatgtgccagaaggaagcacataacctccaaattcacaatctattctttgcccgtttgctgtagttactcttcgtaccaaaggttctgagtctggagtctctgcttccactggtcagatagactttctccttacattgtggtctctcactgaatgttctcacccactgcttcctcactacgtaatatctgcccaagaagctcccgtcttctcattctcccatcccatatgctgacattctttccagtccctgcattgttatgagagctcagtgggggagggagctgaatgtctgtattcagtccacaactacgatctaggatactctgtattaaccataaataattgatgcaagtttcttccactcagccatagctgagccagattacccgcaatgctatctcatcccaccacagtctctacgactaatttctattatgcaaggtaagatcaacatttgaagtgattgagtttaaacataaaaagatgtattggctcctgtgactgggcagtcttcagggttagttgcttgagtgatcaatgataccattaagattatgattgggacatgaaaaaaagaactggcaaataaggagagaactttgaccatagaaaggcatttaatccttgtgttgttttgagcgccctaaaggaaaagacaaattaaaggcagatcctaacagaactattaacaaagaaggaagagggtgaatgagactcttgaatcaaaaattcttaattcttaactccacctgtgaaatcttacttaatctggttatactaagaataatcatcacaccattctgtctcacattctagaaggctttgtagtggtagaactgtaaacaatatataaacatttctgaaatattgtggttgttttatcttccataagcctcacacaagccgtgtgtatgatcatccatcttctgggccattatctgattattgctgctatctctcgctttggggaaaggagagtctctttccttatcaatagtattggatcagctcttctaatttcatgatgacatgagtgttcaggaatgatggaaggcaaatgtaactctgagaaaactttgtttaactactgcatttcacaagtccatatccatcctagaagatcttccagcctgctctctgccttgctcccaagatggccacatgtaggtctcttctttcccgtaaccagagggttatagattatattatctttcaaagtctgggataaaccaatttctcactctaaagagaacaacgtgttttgatttttccaaccctaaccctagcctaaagtctaccttctaatcctatctttattataaatgtccctggattgatctttcaagggatttttgcctactgaaaaaatattactctcactcaaagaattgtggcctgacaagaaatctacaagagtcttggacacagaggccaaaacatcataacgtctggattattcaggctaaagtaatatcacctgtgggttacccacagcccagtcctcagcttcagacaatgccggagtcactagtgttctgttttctttcctctatcattcctattcaaaaattctaaaaatttggagttccatttctcttaagaagacatgaatacattagtacagtaacatatttatctctacttccttgaaattttattgagaaatccatcattttccaaacttttctttctattggtgtaaaatagggatgaatggccatgagcacttcattgcctcatctcaggtgacacttttttgccctttgaaaagcctataatgtactttataatgtagtttaacttttccacttcacctcatgtaaacaaactgattttccaacttatcaatacagtatgaacatttctccaagtcaattaacaaaaagaggaaatatcactttaaatgaatgcacagtttctctatatagagaaaaataatatgtgtgcatatatgcatgtgtaaatatatgtatatgactaaattctacaagtttttaaactatctttttactgatggagactcatcatgatttttttccccctgtactacaaacaaagtagccataaacattctaacattctggagtatggtatcccttatatgaaatgcttgggaccaaaaatattgtagattttggattttttcaaattttgaaatattttcatatcataacatgatatgttaagaatgagacccaatctaaatttatttacattccctacatatagtatacatgtagcctgaaggtaattttatgtatttgtaaaattttgtgcaagaaacaaaattttgactgtcttttggctgtgaccagtcatataatgtcatatgtgaaatttttcacctgtggcatcatatcagtgctcaaaatgtttccaattttgaagcatttcagatttcagattttttagttgaccttggaacaacatgggtttcaactgtgcaggtccgcctacactggtatttttttaaaaaaataaatatatcagaaaaagttttggagaattgcaattgaaaaaactagcagactaactgcatagcctagaatataagaaaaaaattaagaaaaagctatgtacatcctgaatgcataaagtatatgtatatgttaatctattttatcatttactaccataaaatatacacaaatctattataaaaagttaaaacttatcaaaatgtatgcacacaaaccgtacaagtcactatttgcagtcaagagaaacataaacaaacataaagatgctgtattaaaccacaactgcatacaattaactatagcacatactgtactacccaaataattacttttattttatttttataaatgtgctaggtacaagcatacttttattatatgattgttttgttatttggatatattgctagtggtgaagtctgagcttttactgtactcatcaccccaatagtgaacattgtacccaataataatttttcaaccctcactcccctccaaccctggcatgttttggaatattctccagcgtctactttccagtgtatgtactattataataattttgtagccaccccctgttgctactgtggtgagctcatgttgccagtatctgccatgagcacttggtctcttcagtaaattctgtatctaagtaaatagtgtgttctttcacagttctcttttcattgtgcttagtgtaatactataaatcttgaataacaccatgagaccaatacaaagtgccacaagtgatgctgggagtgctcccaagaagcagagaaaagttgtgacattatgagaaaaagttagattgcttcctatagattgagttcttcagctgcctgccatttcaaaataaatgaatccagtgtaaggtcccttaaaaaaaaaaaagagaaattcataaggcctcatttcgtgccaacaggcatgaaaaccttgtcctttcttatctcatattcaaaatgcagcttttatgtggggtacagaattgctataagaaagacatacctatagactcttatttgattcaagaaatagcgaagtcattatttgacaacttaaagtaaaagcaaggtgaaagatctaaagctggagaatttaatggcagcaaaggatgatttgataattttagaaagtggtttggttttaaaaatgtcaggataatgggagtagcaacttctgccaaccaagaaccagcaagtgaattctcaaatgccgttaagaaaaacattgaggagaaaggatatctgcctgaataggtattaatgcagctgaaagtgccctattccagggggaaaaataaaagccacaaaggtcatttattagtaaggaagagaagcaagcaccaagatttaaggcaggaagggataggctaactctactgctttgtgcaaatgtagtcgggtttatgatcagggctgcccttaactataaagctgctaacccctgagtcttgaaagggaaaagagaaacactagttgccagtcttttggttgtacaacaagaaggcgtggactatgagaatgctttttctggattagttccatcagtgctttgtccctgaagtcagaagtaccttgccagtaagggactgctttttaaagttttttgttgttgttgtttaattggaaaatgccccctggccacccagaaccccatgagttcaacaccaaaggcactgaagtgttctccttttcccccaaacacatctctacttcagcctctagataagggagtcataaggacctttaaggctctacatatggcactctatggaaaggtttgtcaacattgcaaaagagaaacccaatacagagaacatcatggaagtctggaaggcttacacctttcaagatgtcatcagttgatatagaaaaccatgaaactcaaaacaataaattcctgctggacaaaagtacaatttgtgtccagatgttgtgcatagctacagaattacgacaaacccaatttagagaaaaccatggaaagaagtatggatatgaagggaaaaaaaggtgtggagtgaagggttgcaagatatggatcttggaggaatttaagagctaatacacaccacaccagaggaattaacaaaagatgacttcatggagatgagtgcttcctaaccagtgccagataatgaggaagaagacataggaaaagcagtgccagaaaacaaattggcattcaacaatctggcaaaagagctttgattattcaagactacttttgacttcttttatgacatagaccgttccatgatacaggaactgaaactaaagcaaatggtggaagacggataggtactacactgaaatgtttttagagaaatgaaaaagcaaaatagacagaaataatgatgtatttttgtaaagtttcaccaagtgtgcttgcctcttttgcttccccttccatcccttcaccctcttccacctctgctaccctaagacacaaagaccagctcctcctcctcctcctctgcctactcaacatgaagacaacaatgatgaagacctttaggatgatccacttccacttaatgaatgggtcatatattttctcttccttacaattttcttgattataatttcttttctgtagcttagtttattgtaagaatacagtatataatacacatagcatgcaaaatatgtcttaaatgtaacgcatgttatcagtaagccttctggtcaacaataggttattagtttggggggaatcaaaagttgtatgcggatttttcactgtgtgggaggccagctcccctaaccctatgttgttcaaggggcaacaatattctttctcactggcactttactttccataaattcaaatcccaaaagtagaactgcaagttcaaaaggatttttaaaaaaataattactgtcagattacagaaagtttccaatttacattttcactaccaatgtacaatgttggcgtccctgaatccttatcagcaatgaatttttaaatatactataagagatgaaaaaaatttttttaaatttggaattccctgatcactaatgaagttaagcatcaatattattcctttaatatgcaaatgctgaaaatacatttaactataatagatgtcaaaaatctgtaaatcaggctaggtgtggtaggcactcacctgtattcccagccactgggagacttgagtccaggagttccagactgtagtatgcaatgatcaagcctgtgaatagccactgcactccagcatggacaacatagcaagaccccatctttttttttaaaaaagagtctataagacaaaggtcctcataaattaagagaagccaagacagtcactgtgactgcagaatattttaatttttttttattatattttaagttctagggtacatgtgcacaacgtgcaggtttgttacatatgtatacatgtgccatgttggtgtgctgcacccattaactcatcttttacattaggtatatctcctaatgctatccctccccccagccccccaccacagagcaggccacagtgtgtgatgttccctttcctgtatccatgtgttctcattgttcaattcccacctgtgagtgagaacatgcggtgtttggttttttgtccttgtgatagtttgccgagaatgatggtttccagcttcatccatgtccctacaaaggacatgaactcatccttttttatggctgcatagtattccatggtgtatatgtgccacattttcttaatccagtctatcactgatggacatttaggttggttccaagtctttgctattgtgaatagtgccgcaataaacatacgtgtgcgtgtgtctttatagcagcatgatttataatcctttgggtatatacccagtaatgggatggctaggtcaaatggtatttctagttctagatccttgaggaatcaccacactgtcttccacaatgatttaaccagtttacagtcccaccaacagtgtgaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatacttctcccacttgttgttggggttgtttgttttttcttgtaaatttgtttgagttcattgtagattctggatattagccctttgtcagatgagtagattgcaaaaatgttctcccattctgtaggctgcctgttcactctgatggcagtttcttttgctgtgtaggagctctttagtttaattagatcccatttgtcaattttggcttttattgccattgctttcagtgttttagacatgaagtccttgccatgcctgtgtcctgaatggtattgcctaggttttcttctagggtttttatggttttaggtctaacatgtaagtctttaatccatcttgaattaatttttgtaaaaggtgtaaggaagggacccagtttcagctctctacatatggctagccagttttcccagcaccatttattaaataaggaatcctttccccatttcttgcttttgtcaggtttgtcaaagatcagatggttgtagatgtgtggtgttatttctgagggctctgttctgttccattggtctatatctctgttttggtacaagtaccatgctgttttggttactgtagcctcgtagtctagtttgaagtcaggtagcgtgatgcctccagctttgttcttttcgcttaggattgacttggcaatgcgggctcttttttgtttccgtatgaactttaaagtagtttttttccaattctgtaaagaaagtcattggtagcttgatggggatggcattgaatctataaattaccttgggcagtatggccattttcacgatattgattcttcctatccatgagcatggaatgttcttccatttgtttgtgtcctcttttatttccttgagcagtggtttgtagttctccttgaataggtccttcacatcccttgtaagttgggttcctaggtattatttcaaatattattgtaaaacaatgagatattgaaacatacattggagcaaactcttcttcattcttaaatcctttcagcacagagacaatcaactgactgtctgggtactacctgaccactattggagtctctttcatctgcctgagtctgtgcaacaatatgaaattataattttactatgcacctaaactttcctcaatatattgaattcttacagaatttgaagagtcaaattttgtaaatccagttacctttttccactactctaggcctcatatactatctggcctaagggttaaaggtccacaattgaataagccaaacttgttaatttgagggtaaagcatgtcaagaaatctggccttaatgtccaatgaacttatgtcatattaagtagctggatagaaacatgcattccaaagtggatactgtttatcaggctcagtgctctattcttgacagtaaatcccagaatagggtggatgctttaattttgtattaaatagtattaggtgtaatatcaaaaccactaagggaacactaatgatgagaataggaacactagctgtggagctggcaattttctatagaaatcctatctctttcaattgcctgtttagtgggcaagtgtttcagttcctataatatctaaattggagaaaatcaccccacctacttcttcaggtgttatgataattatgagggataacatctttttaagtgtttaacacaattcctcacacatagaaagcaataataaacattggctagcattgtaaggatggattattgtctttcaatgtgttttcatacattttctttctgggatcttgagtgaaacatgtggatctataacaagaacaaaatgatgttaccttgatgatctctatgtagggtcacactaaaggcatcttaaaatattttgctggccaacaaaagacacctcctgttctaattgggcattgtccttttctttaaactatgcagacaaacaatattataaagtgagaacatccacataaaaaacctaaacataaatcttaatagtgagttcatgaaaattcttactgatgaaatggcaatgtcacagactgactgtttatgtccccccaaatttgtatattgaaatcctaacccccaaactactcgtgttaggagatagagccttggggaggtgattaggtcatgaggacaagattctcatgaatgggatttgtgcccttataaaagagatcccagagagctcattggccccttccaaagtatggggatacagcaggaagttgccatctatgagccagaagggtgaacctcaccccagatgctgaatctgccttgatattggacttcccagcctgcacaactgtaagaaatttctgttgtttataagttactcagcttgtggtattttgttacagcagcctacacagactaagacaagtagcattttgaggattaaaatttcttcataaatgaatagagtatgccctgttaaaccatattctcagctaaccccatttactcactgttcctctttattttagtttcacatttttgctatttatctctgtaatttcattcaatcttcacaatttgccattcttatacttcgaatcatgttatcagtttataatacctccatcaaatgatagtctgcatttgtttatccttggctgattcaaaacacttggcataatttccttaaaggaaatcatcttcatctcacctcacaacactgtattattttcaattaatttccaataaactcttaattgtccatgctctgtcagagttggcagagttaatccctgtttaagctaataggttcaacttcttcaacaaacaaatctggctgctgacaagccagagtattaattaaatctagtttcattgcttctcactttccttgatctttctctcttgttctttgggaaacagtcacagagttctggcgctaataaatactataaaaagtaggaaatacagtctaaagaagcagaatattctgtttaaagttgatgtggtgctttttgtgcaccaagcattggctcaaaagcctgaaaattaggcagcaatacttcctaagctcatcttcaaccataaggcagaaaagccaaacatatctgaaaatataatatcactggtaccttataccagcactaagaataagaaaaccctggaaagtggctcaagtacaatatttttctattggaattaatttttcaaaatggaaaggacttcattgttatttttattataaaattagtatatgtttattattaaaaataagtacaaaaatctctaaaagaaaaagggaaaaattaccagcagttccacattccagatatcatcactgttagcatttaggatacaaatatccaaacactttttctatcaatacatttaatttttaaatttgaccattacgcaatgtacacatgcactaaagcaccacactgtaccccataaacatgtgcaattattatgtcaattaaaaacaaaataaaagcattttacaaaaaatcatgttatttttaataacttgtttttctaattttatacaccataaaataaatgtctttacatgacatttattttatgataataactaatttactcatttaaacagcaaggtacatttcattctacagatatactatataatatttactctgatctctggatgagaatttatgttgcctgtaaatattgtatcacaaacattataagaataatctctgtaaaggtttttttcctgtattattatttgggtagaaaaattactagaaatagaataactgggtcaaagattaaagacaatttaaatttcaatatatagaatcaaattattctccaaaatattgtactctacagtatttgaattttgatttttttctccattttcactactgccaataactttaatctttgtcgataaatgagacaaaaaagacgaataatgcaatattatacaagggagattaataggtagaaaaagaaatgtaatggccaggagtaacagaagatgttcaacatcaatccaatcaaattagtctttaaaatgcaatagcagtcaatgttagcaagagtgtaggtattagacattctcataggaatataaactagggccatgttttaggatcatattagatcgcagcaattaaaaaatgttaaattcatatgttctatagcaacttttcaggttggaatttatcacatggagaatcttgtaaaatacataaaccaagatatgttattaatgttattggtagcctattgtttaaataaaaaatatatttatacaatacagttgttaaaagttaagaatatcttgaaggtaaattattaaacaaaaatagaaagcctaggccaggcaagacttcatgtcatgcttgtaatcccaacacttttggagactgaggctggaggattgcttgagcccaggagtttgagaccaacctgggtaacacagtgagacctcatctctagaaaaaaaaaaatacaaagcttagttctgaacatccttttgtgtaatactaaaagataaaattttattttctaacttgtttaagatctatattctatacgggggatgtgtattaaggtcatttttaaaaaggtactcaagaaattgtcaacagtgattatcttaaggagagattctagatgtctgggggtaagagactagaggaaagagaattttatatttcatttttacctttatttaattttttgattttcttactgggtgcatgaattatatttttatgtcagcatgttttatcagataaataaaattatgagctatttctgttttctctcatttgttttatgtttaaataaaggaaaatgagatatgtctttttaaattagataatcttgagtccatgattattatgaaagccctctgttatctttttccttcctttcacaatgactatttatgttgtagaatcattaatttctcaagacaaatgtcttagaaggtagatacaaaaaaaggtatacattttttgattcaagctaatttcatgttatgaacaaaattacgtaatgtcatttctaagacctttctgtgatctatcaatccactaggttaaagagcagaaatcacttccaaaacaaatccttttgcagtcagcaaaatgaagcaattatatgaataagtttttccacttggcctatttttctacccagggttattaatcagtctcattgactacattttccgttttacatcccctttcaggcactactgcagatggccaagcatatcacattatgtaaataaaataaaacaaaatcttctcccattgagcaaatggatatacttcacctctaatgcttccagtctttctcagatcattcaaaaagcatgatatggtttccataaaaggacattcatcccatttgactaactggaatttctttactccagctaatctttaccaaagagctgaattaattcaagttgacaccctgttatctaccagctcttccagcccttttgcttgattgttttgtcattttgtcttttcttttcttctaaagtgggagtatggagatttacccttctgaaacagctgtgtcacatcatgatccttgaggatatcagctcttaactggctgcacatcaaaatcactgtttcctttgaccaatactctagacacactcaagcagagattctggattctgatttaattgacacagagtagggcctgggcatttttacagctccccacatgattctattgtgcctcatctatcctagcccttaagcaggaccaaacatttgttctatcttaattattattctcttaaacttagtccaattccttacaactgatagctttctatatactcatctgccttgagtgatgacaattgatatggtttggctgtgtccacacccaatctcatcttgtagctcccataattcccacatgttgtgggaggtgcccagtgggagataactgaatcatgaggatgggtctttcctgtgctgttcttgtgttagtgagtaagtctcatgagatctgatcatttttaaaatgggagtttccctgcacaagctgtctctttgcctgctgctatccatgtaagatgtgacttgctcctctttgtcctccaccatgattttgaggcctccccacccatgtggaactgtaagtccattaaacctctttcttttgtaaattgcccggtctcaggtatgtccttatcagcagcatgaaaacagatgaatacaacaatactgtaacaaattgactcacatctgttctctttataggaattgcaatgctacaatattagtggctcttaattctaagagtgttaaaaaatattaatgcttgtctcacccctaaagtctagggtgtgacctgagtattaggttatttaaaacttttctcaggtaatagacatgtgcagccaaggttgagaaccactctatagggccaagatatgtaagaaaattcaagtcctttagctgggcgtggtggcacacagctgtagccccaggtactctggaagctgaggtgggaggattgcttgagcccaggagagagaggctgcattaagctatgatcacatcactgcactctagcctgggtgacaaagtgagatcatgtcaaaaaaaataaaaagaaaggagaaagaaaggaagaagaggaaggaaggaaggaaggaaaagaagaaagaaagaaaggaacaaagaaagaaagaaagaaagaagagaaaaagagagagaggaagaaagaaagagagaaagaaagaaaagaaaaaggaaggaaggaaaggaagaaagaaagaaaaagagagaaagaagaaagaagaaaaggaaagaaagaaaggaagaaagagagaaagaaggaaaagaaagaaaattcaagtcctgccttgtaaaatgcagtactccattttcccaaagagatcccaagggaaacttaactacaggataaagacaaacaaaaggacataaattacaactactctaggttcacatattattttgtttctgaaattggttttaaaatatctatgtcagagttcatttctagaactttatctctagaaaacatattttcacttctcaatacaggaaaatggagactggaaaaatgaggttggaaaatgatttccatgcttatctctcagcttcttttttcaacttccctttttcatctccgtatcttcactgatacctaggaatctctgttacatcacagtcttcaagagctttgcttgcagcaaattagttaagacattagctttcaaaagtatatgatattctctcacaagcatttgtctacttttaatagggcaagctacgtaaagatgttaaatctcattccagaaataccacatctactctacctatttatgagaacagtcgtctctagaccaagatagacattcatagttaggaaataaatccctgtaggctttttccacagtcccaatatgtcccctactgtcccgattttagcaacaaaaatcccccatccagaaaatccttcattcctgagtaagttgaaagattggtcaccctatttctatctgtgtctctttctttcataattggctcataatcatagcagtcacaattttgaaaaattttattttactgaattactcattgctgttttctcattttttaaataataaacacttattaagaaacattggaaatataccgaaaatagtaaacaataaaacagaaaccattggcagaaatagtcactattaaaatcttaatatactcccttccaatgttgtttctgttaatgcaaattaaaaaatcagagattcgcctctgtgaactagatctttttacctttagatattatttgacaaatatatagctcgatcatctatccaaacttctcttttacagactccatgccaattaaccttctcctatgaaactattatttcttcacataggataaatatggtttttgacacacaaactttcttagttacactgcaatccagttgtgcatctctaaatttataccaattggatttagaatgatcattactaaagaggcttggtcttatctcttgcaatttgcttcttccttcttaaattcaattcttgtaatgtaactataatttgggggtattttttgcctcatattcaaattctctttcaaactgaggtacatttctgtatttctgtatttgtatattgtatataatagtatagaaaacaataatgagattatagtgtacataaaagttttgaattataattaaatatttaatatataaatatattaaatatgtataaaatatctgattagtaataagataataatttaaaacctctgagttttaaaactaggactttgaaataccagcaaaggccacctgctttgaccaacatctcttttccctgcctgctttaatcatgtcttgggtcctgacaaatttgcccccagatccctcccaaattactctccaactctgttctatgtttcaggaaaataacatttatttcccagtctcctttgccctccattttcccagtaggctatccagtgagagatgccataaaagcctgcctcttctctgcagggctgcttcccaccagatagcccctccctccatggacccaattcccattagctctagcaacctgcctgaagtcctggccccttggctctgataataacaccttcttccatgatccttctagtcctaggggcagtactggtttcttgctcttgagctgctgactcaccaagcctggtttggcttccatcacttgtgtaatcaatcacctgtattaaatcacctctgcttgaaagacgaagaatagtttctgatttataagcaaacactgaaagctcttctatttcttgtttgctaaacaagatttgtcaaagttaaatattttattttattgaattcactttttgcctcttctacaatgatgatttgcttttcctcctttaacttgttaatgtgatgaattatacatagttttttttctattgttagaaatccttgcattcatggaacaaacacaattttcatactatattatcttttttacagatttctaaacttaatttgctaacttttaatttaaaatgtttgccgttaggttcatgaggaaagttggcatgtaattttcctgtcttacacatttctcatataacattggtatcaaggttgtactggcctcataaaatgaacaaacaaatggacctttttttattctggagttgtttttataaaatggaaataatcaatttcttgaaaacatttgatagaactcaccagtaaaaatgtctgggcctgctggttctcttcttctaagaagaatttggaacttataattaaagctcctttaatgtgttagaaaactttccaggtttccttgaacattaataaattccaatgatgaaaagccctcagatattaaatataaccttaaatataaccttcccccaattcaatttttcttttgcagatatgattagatactctaatttttcaacctctatttcacctatccattttcctttcctcctctgtactgtcttcagcataatttgtttagtctaacttccaactcacttattttctttttggttctatccaatattgtgtttaacctgtccatttagtttttaattttcattatattttttatttctaaaagatctcttaagttcagtttcaatctgcttaacataagatacatacactgtctcaatttatattcctggcacacctcattgattttttaaacctattaaacacagcttttatagttatataatcatcctaatatctgaaatctttatgggcataattctgtttctgctcatgatgtttatttcctcatgagttttgtaagagtcttacttttttctcattttggatgaaattttacctgtggccattctttgagacatgggctgaatgtgggtttctccaaagacactttgccttcgtcttgtgtttggtggtaataccaacatgggataactataaaataaattatcagtttcatgtgtgggtttttttaaaattatacttacagtgaaaatttaaaccacaaattcatgtgaagatggccttctaatttttcctctaaatagcaccgagtttgaggcaggaaaatttcctggttgtctccccctgaggaacaggtttttatctagtttatcctttcactgaaattatagtccttcatatctctggctttcagcagttttctcctgtaagactgctatactgggcaggcactaggttttgtctcacactctcccatatcccaggtggtcataaaaattgaagctcagggtactagggccaggactgtccttatggaagcttctggtttgggggtctgcatacctctctggatttatgtattctccttatgcttggcctatgtggttcaccttaatttctattcaagtcagtaatatacttttgaaaaatgacatgtacattttatctggtatttgtagatttcatatagcaggatagtgattcaacaaatttagtctgtcacaatgctaggaatagaattcccctaatttttgaaaaaattatatcaaatcatgtttattgccattaatagtcttataaatgtgcttttaagtaactgcattttgtcatagctcattgtgattgtatatttaactaattcacccctacctcatgttttttgggagtgaaggttgtactcaactcattatgttaagtaatactacagtaaacatcaatctatacatgcattaataatgatttccaagaaagtagtgacacatggtcataatcatctttgaggctgatggtacatattttcaaattgcatctcagaaataatataccaatctgtgctctaatcagccgcatatgaaagtgtcatctttctgttctccaaccaatacaactactactgtttttatacctacaaatctgacaaagatgggagaaggtatcttatagtttcaatttgtatttctttggtgaccaatgtactaaattactcaatgtactaaattactcttttcctgtttatcatccatttcaaacaagatgtaaaccattttaaatttttttatattaatgcaaatcgtaaatcactactttatttattcaatttcctaagcaaaattatatgttgtcccatttatacattttatattagatcattctgccttacatttatatcctaaaaactgtcagaattatataataattatgaacagttgattataaataatgcctttattaggatatttctccataaatctaaatttcatcaatctttctttaaatatctctacacaatttcctcttgtattatattaataattgcagatacacttctttttgctatttctattaattctttcctattcctattgtctgttagtctcccattttctcccataaaataaataaaaatttttctatcagattctgtgatatattacttcttattcccagccttcaacattttaagaattcagattgaccttttctcccattcttatttcaagttatcagcatgtcaatacttgggaaatcccatcaagtgtttaacagtgcataccttactgattcattatttatttcaatttaatctttcttattttcattcaacttttttctcagtaatacaactttttcaagctttttattttctaatgcatttctccaaatagcagccataacccttatatgccctctttcaatgacaacaacaaaagtgtgctaggcttcttggaagaaaataattataccaatttaagaaggagaaaattgatgtactgataaacaaatgggcatcttaggatcatgtttctcacaagtaaggcagttccagaaattcctaggaccctaatgggttttattctaaataggttaaacatatcacttaaaaaattgttttctacagttctctaatattgcttacaattgtccacgtttccatgtttataaacttgcacttttttttttatggagttttgctgttgttgcccaggctggagcccaggctggagtgtagtggcgtgatcttggctcactgctacctccacctcccaggttcaagcaattcttctgcctcagccttctgagtagctgggattacaggtgcgtgccaccacacctggctaattttttgtatttttagtagagacggggtttcaccatgttggccaggctggtctcgaactcctgacctcaggtgatccacccgccttggcctcccaaagtgctgggcttacaggcatgagccactgctcctggccttatacttgcacactttttaattctaagaccttgctactcagtgagggatcctgggactaataccatcagcttgacttgaggccctctttgaaagcagactcagaatctgtaatttatcaggatccccaggtaatttgtatgtgcagtctagtttggtagatctgctctggcagactggaagactcttctatctgcctcacgtaaggtgcaggtgacataattaggtaatcaagcaaaagatcacatattttaataagaaagagacactggctattattttgagtggcaaaacaggttattcagtcccagtttaaaatggaaatgacagagaccaagatcaagatttttaatttgagatgtgcctgcgatgcaattacatttgctgaatgaaactgcttcagtaattagatgcaggtttcttctctcttctttttgagatgtaaagaagacacaatagactcatggaacttaaagaactagacaccagctaacaaaacatgctatccagactcttccatttcaccatattgctttcttgaaaacataggacagtgccagtttagcactgaaaaaaatcagttctcctaattctaaaaagaggagacagccaggcgtggtgggtcactaaacatacaaaaaattagcgggcatggtggtgcatgcctgtaatcccagctacttgggaggctgaggcaaaagaatcacttaaacccgggaggtgaaggttgcagtgtgctgagatagcgcctttgcactctcgcctgggcaacaagagcaaaactccatctcaagaaaaaaaaaaaagaaagagagagagagaaactgtaatttcatttcagaagttttatagggtactatttccaattctttttttcttactccattaaagtgtaattagcagtatgtgaaaatttccactttatcctcaatcagaagcctctccttccaattagcatattttttttctattaactttgtaaagtgggattcttgttttatacatacccctggaaagtatacttaaactgtgagaccctgggattttatatttccaaatagaagataccatcctcttgtatcacaaaatgtatctaagatggtttggattatatttaaatattcttgaatgaaatagacttactgactgaagccaattattagatttttccacaccaaaataaatgcaataggaaaagatgacagttctatgtagtattcctgcttccatattgcacaaattagaaacatacatattctattatgttacagggtctagggctttgggaggacaaggctgcaggcagccgagattgtgccactgcactccagcctgggcgacagagtgagaccttttctcaataataataataaaagtaaaaagaaatataatatttaatcaatatatgcacacacatgggtttatcatgacacacatgacatgtgtgtacagtgaaaacaatgagtaaatctagaaacctgtattgcctcaatagctagctaagtacttcaatatgcatgtttatttcaacaattttgtgttaagctttagtggtaaataagcagagtacactggccataatgaatactccttttgatgagggttatcactacacaattaaaatattacatagttggctgggcacgttggctcacacctataatcccagcactttgggaggccgaggcaggcagatcacctgaggatgggagttcaataccagactgactaacatggagaaaccccttctctattaaaaatacaaaattaaccaggcgtggtggcacatgtctgtaatcccagctactcaggacgctgaggcaggagaatcacttgaacctgggaggcagaggttgtggtgagccgagatagcaccattgcactccagcctgggcaacaaaagcaaaactccgtctcaaaaaaatatataataataaacagatatatattatatatataataaatataaatataatatataatatatattatatatataataaatatataatatatattatatatataataaatatataatatatattatatatataataaatatataatatatattatacatataataaatatataatatataatacatataatatatatattatatataataaatatatcatatagatgatatagtttagagttaaatactgactgctcttgggaactttgaggtattctgagggatataaataacacgaagagaatagcacattggcttgaagcagattagagtctgctacctgcgtgaatacttgcttttcatgaactatgaggatgcccttagcttttgaaccacttctacttgtgttgaaatttaccctttaattttggggtttgacaggctctgcccttctgttatgcttgagtctggcttttcctactctgactcactttgattcttgacctctgaatcttattcctattttacaataaacacacatcgcacatacgccaattagtagagtggaagagggaaaaattgccaaggaactatgtttaattttgttcctttcgcaaaccagacaccataacagaaaaattttaggaacatgtgcatgttcagtagccttcaatgcaattatactggttattaaaaagtgttggataatcaatattttttaaagattcactagtcccttctcataattttagaactttgggaagtaataatacaaatgtatttttagctgtgtcctttaatcttttactgtttcctctatgtgtggtgtttggtttgtgtgtgtgtgataattattataaagatcagaggctaacagaggtgttaatcacgaacttttaaatttttttatttttatttttttattttttttaagagacagagtctcgcggtgttgccaaggctggatgcagtggcgccaactcagctcactgcaacctccgccttcagggttcaagcgattctgctgcctcagcctcccaagtagctgggactgcaggagggcaccacgatgccccactaatttttgtatttttagtagagatgcggtttcaccatattggccaggctggtcttgaactcctgacctcatgatccgcctacctcagcttccctaagtgctgggattacaggcgtgagccaccgcgtctggctgcatgaccttttaacttgtctcatacactcaatattctcaagatataccttccaaagtgaaaaattatggcactttgcagccctgtccactaactgagaactttgatgctttggattttggagacctcattttatcacctggtccttttacttcatgacttgtcatgctgccaccttttgatgggattgagatcaagataataattcccaactggtcaggaatattgtgcccctttgtttttatatccagatgcaatagagcctctgacacaccactactattgttcttaggatttggaacaaaatgcttctttctttgacaaaataaatgttttctttaaagaactcttgattgatcctggaccattgtagaaactgaagtcctatcaatgcaaaaaaatatgacaacatgagctgcttatcatgaaataagtgttttccaattaactatcctgcttcatcagcaggtaggaataatagaatctatacctatgtcttcatgggaagttctctatggccagttgattagtgagggaaaaattgagcctgatttacagaagtcactgtacaacatcacagcaacagccaaaagtagattgcttaggcattataacctacgtgaatgcaattttaaaagaaattcagcctatgtaattggttgtccacgatgtctagaaggagagatattattgatgtatatgtggcagctaataatttgtctagataattagggacttggggccaggcctgatggttcacacctgtaatcccagaacttttggaggacaggacaggtggattgtctgaggtcaggagttcgaaaccagcctggctgacatggtgaaactccgtctctactaaaaatacaaaaattagccagatgtggtggtgtgtgcctgcaatcctagctacttgggaggctgaggcaggagaatctcttgaatccaggaggaagaagttgcagtgaaccaagattgcaccactgcactccagcctgggcaacaaagtgaaactctgtctcaaaaaaaaaaaaaaaaaagaaaagaaaagaaaagataattagggactcagaaagacaaacactgaaggattggtggcaatgagttttggggaaaaaatatgtagatgaaccacagaaaatgagccagagtgtaagaatatttgtgcttaatacaaatgctcaccaaactatcatcaggaaggttatcaaatagatatgaaggtatgaaacaatctctttcaccaggcactacattgcttgctcagaaggctaataaacagcaacattggtggtagcagtagagaatacacataggtttagcaacatgttggactttaccactctcgcttacaaaagcctatttagctgtcaagactattaggtgtccaacacacaagcaacaaagtccaaggctaagcacacaataacatatcctgggtgaataaaccagtcaccttttgtcagacttgttgattttactggagctcctctatgataaaggcaacaaggaattttgtaaatggaatctacctttatccttgaattacatttgctttacctgacatcatttttctctgatcgccactctccatgggtacattgaatgccttatatatactgccataatatcctgttctacatccttctattaaaagaacttgttgtataacaaatgagtagatattcattggactcacctggtccaccatttatcctatcaccaaccaaaattattattattatagaatggtgaatattttattaaagactcaatcacagtgccagctggagacaatggcttataaggttgtactcatgctagacgatgtggtggtgtatcctctgaactagtaactaagtataagcttgtctggtgtctcccatataaaaaatacaacaatctttgatatttgttatgaacgttgaagtgactccttttgtcattacatctaatgatccactccaaatacttgtctcttgtctctgagattctaggtttttgcagaattagtacccaaagggagagtcttagcagtattccattttacaatccatccttcgttagaggatgagagacttctatctagccttttaggttgcctgagacctttaaacaaactgtcaaaaatttaaaatttaaaatgcggctacattgttgcatggggtagtaaatcttgaccttaaaactggtatttgtaagaaaaacagaaagaattcagggatcccctttgatggctcctaattctatacagtcctgtaaatattcctgaagactaaccaggcgtagtggtgcacacctataatcccagctactccagaggctgaggaagagaatcacttgaacctgggaggcagaggttgcaatgagctgagattgtgccacttcactccagcctgggtgacagagcaagactctgtctcaaaaaaaaaaaaaaaaaaagaagaaagaaagaaagaaagaaagaaagaaagaaagaaagaaagaaagaaattaatgaagactgccacaacttggaagcaaccaaggtatccttcaataggtgactgcataagcaaactgtggtatattcctacagtggaatattattcagtgctaaaaggaaaaaactatcaagccacaaaaagatacagaaaaaacaaagacattttgctaagtgaaagaagccagtctgaaaagggtacatactgtgatttcaactatacgacattctggaaaaggacaaactataaagacagtaaaaagatcagtggttatctttgcagacgccaccatcactgtgagccctgtactatcagccatggtcaactccgtcgtcttttttgacatcaccgtcgacggcaagcccttgggccgcatctccatcaaactgtttgcagacaagattctaaagacagcggaaaactttcgtgctctgagcactggagagaaaggatttcgttataagggttcctgctttcacagaattattccagggtttatgtgtcagggtggtgacttcacacgccataatggcactggtgacaagtccatctatggggagaaatttgatgatgagaacctcatccgaaagcatacaggttctggcatcttgtccatggcaaatgctggacccaacacaaatggttcccagtttttcatctgtgctgccaagactgagtggttggatggcaagcatgtggcctttggcaaggtgaaagaacgtgtgaatattgtggaagccatggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatcttggtgctcttgctgcagttccctttgggttccatgttttccttgttcccttccatgcctagctggattgcagagttgagttaagtttatgattatgaaataaaaactaagtaacaacaacaacaacaaaaaagctcagtggttgccaggagtttggggatgggtagggagataaatagttctgaaacaggcgatttttaggggattgaaaatacattggtaataatgtaatgatgggtacatgacattatgcgttttgcaaaactcctagacctgtaccacacaaagagtgaaccctaatgtaaactgggggtgggataaaggtgacagtatgtgagaactctgtactttctgctcgatctttccataaagctaaaactgctcaaaaaataaagtctattattttgttaaatgaaagaaattaacaatgaccatggcacgctcacacaaaaagattatcaaggacatttctctgtcaggaatgaatatttggtcatctcacaaggcaaaaccctgactagcagaggtgttagctgagggcacatggccatagatgccaatagtgacctgctggccacttgcagaaaggagagccttgacatccaaacacattgtttctcttgtattgtcctgtgcatacttatgtatcttaacaactttccttctttcctctccatttatccctctttttaaaacagggcttattgagggtgattaacttaatttttaaatgatatatggcagaatgtcaagagagtatagtgaagaacttcgtagaggaatggacataacccagaattcttagacttagagtacatgctgtgattgagaattttttattgtttcattgttcaagagattgtaggtacatgttcaattattagagaaatagttgcactctgttagaaggaagcttgggtctttcgtgtttactttcaaaagggaaagtttatattgatattgagcaagttaaagcatgaaaatttattatttgatgtttgttgctgtgtttgaggaattcctcagcctctcagttttgacgaaaacaagaaaccacctcctgctttagaagctaaaatgccaaatgcttgctttctcagcctcctttgcagctagggtacaagcatatgacttaggttttgcccatctgtttgccagtgctgaatttccacttcggaattaataaaaaaagaagcagattcagttatgctttctcttgtttctggtggaggccatgtagcagctgctacaatatctgttgcaaagcgaacaagtgggagtggtgctggtggctttgcagttagcctaggattgagcaattgctgcaattgttgctgcctgcatcttcggtgttatttcttactggtggtgacagtggtttcctccctggatgagttctacagcatggtttggggtacatttcctggctgcctagctttgatctggctttctagccttctcaacagttctacaagttccccactatttctgtgataaacctatttattgttaatgtcagccataattggcttctgtggtttatattttttaaaattccaagatataccaacgtaacagatagctcaacaaacatatgtctttttaaattaagatatattctgtgtcacatgaagtacaatggacaaaatgcaacaaattgaattgagcaaaagaccaaatatatattaagcctggctggtcttaaaaatgtaactggatacagccaggcatggtggctcatgcctataatcccagcactttgggatcctgaggtgggcagatcacctgaagtcaggagtttgagaccagcctggccagcatggtgaaaccccatctctactaaaaatgcaaaaattagctgggtgtggtggtatgcccctgtaatcccagctactcgggaggttgaggcaggagaatcacttgaacctgggaggcagaggttgcagtgagcccagatcatgccaatgcactccagctttggcaacagagcgagactttgtttcaaaataaaaaaataaaaataaaaaaataaaaatgtaactggatagacctaaggttcttgaataagcagaaaataatttaggtaaaaaccaaataataaactaacattctgaaaggtttaggatttggaggcacaaatgtcttagctaaagtgttcattctaacctcacaggaaaattgaaatatgaaaatatacagaaaaatcttaggcagtatttgtcaattttaagaaacaactatttacaggtttttcaataggcattacattaaaaacgaaatatgtagttaataaatatgaaaactgtggatataatcaacacatttattttacttcttgaagtgttaacatgtgctgtctcaaatatcaacagtgtacacgtgagaaaaaacattttacatagattttctgcgacagaaaacagcatctcattagacatcccaagttttttcatttggaacacacacccattccccagtatactaggggtattaataatttaaagagtttaattactttttactactagaaaactaattttatgtttggcacaaatttctgaaatgatattctactgcaaagaataatacctatatatggccagaattactttttttctataacattaagataatacttgtcagcctgagcaacaaagtgagacctcatctttacaaaaaataaataaattagatgggtgttttggtgatgaggttctgtagtcccagatactcaagaggctgaggtgggaggatcccttgagcctaggaggtcgcggttgcagtgaactatgattgcaccactgcactccagcctgggtaacagagcaagatcctgtctcaaaaaaaaaaaagataatattggtataattcagggtttttgcctcagtccccatgcttcttcatttgaccttccctgactccctgatgaattttagtttgaatttttgctatagtccagaagttaatttaaaagatcttaaaatttccacctgcctagatattacttatttgttacactttagtccatgatttctattgtcatttacattacctcaaaaatatgacctgctgaatttctgctgtcatgaattgactaacatattttgggcctaatacctttacatttagaatctttttgttttgtattggaaagtattgtaactcctccatttattggtcaaaagcactgcttatttatttccatgcttaatcagagagactttctaatagttatttaatattatttacgttcattcacttgttgactataatgacgttagttgctatgatatttttaggtcattaatataataaaaatatgtcaacttttctcttccaatgtgtctttgggttattaatttttaactcagatatcaagcttgtaaaatgtttaatggcttataataatgtctaacacatagtatccactgagttctgataactccagtttatcaaattctctttttttataccattctccaaatgcaatgctatttggttttatttttattttttaaaaatgtgctgcctgttttgagtctctaaaagtgtgaaatgctcagtattttccaaatgtatttgaacatggagtgttatatttactaaaaagttaacaagcaagtattcccctaaacgttctagcaaatactactagtacagacaaattatgatgtaacattatagtacattttaatttattaggttaattttggttgcaaacaatcaaaattcaaaatggcttgtataataaagagattttgaacaatagtataggctcaagatagtttaatgcagaagtttaataataacacaaaataaatgcttcttgtcctccctgtttcttcactctaccttaagtgatatagattgaatgtttgtatccccccaaaatttgtatgtttaaatctaatccctagtgtgatgatatttggcagtgggtcttcagggggtgattaggtcatgaggacagagtcctcatgaatgagattagtgcccttataaaagagaccttagagaacttcctagccccttccaccatgtgagggcacagcaaaaagacagctgtctgtgaaccaggaaacaaatcctcattagaccctgaatctgttgacaccttgatcttggacttcctggcctctagaactgtaagaaataaatttatgttgttcataaaccatccaggctgtgatattctggtatagcgacctgaaaggactaagacattaggtctcagttttattctatggcttaaaatatcatgtcatgagtagacaacttccaatcctagtacctcgtgcttcctctgctgcatttggaaagaaggcatttccctcttcaatcatggaatgaaaaagttgtacttcattctgatttgattagcagaaggcacacgttccttcatgcaccaattacagtgaccaagaattgggcatgggactcatgtcacttaaacattgtgaagctgagaaattcattatttggctaggagtgtgtgagagcagggaacactgaatgcttgagacaccaccacgatgtccactacatgtatttccatttcagtaaacatttccattaagataatgctagaacaaaatcagaggagtagatcttagtgtccccaacttttgttgacctaacaaagtgaagttgcttcaactggacacttctgaaccacatttatgcctatatgttcagttcaaatttattataagcaattttcaggtccatatgtttaggatatttcatttgtttggttatgcattatatgtatacatgtttttaacatacatacgcctctacatatattttggaggcctttacacaaaagtgttttccctaaagggagaagagaaaagttgaatgcagaagtagaaaaaaaaattcatttgcacttgtagtatttatatctaaatattttatgttacagatgtattaatatttttataattttaaacactactttaaaacagggagatggtttaccttcaaaaaatttggctctcaactcaaaattatcaaagtatatcctagatgtagtttgcttgtcaggcttctacatgaaaatctaaaatgctcctgcatttcagaatgagcctaacatatgtaattgcactcatccactatgtctacattgccaaccaaatactgacagagagagctagagtgccacagagagctggcagttcctctgtttgcattagcttctacttgcttcttcatctttcctctatgtctgacacatttcatgttactgtttttaaatgttcccttagctacagagctaatgtgcttatatctgtaaggggtctcatgtgaacctctaaataattaaagattcattagctccctggagggccaccatgatttccaaaacaagtcacaatacctaaagatctaattgtacaatttccctcagaaatagccttgagaaagaagtcacatcactcagcaatgagtattataattactcacagcagttttcatggtactatataacatccaatttacagaattaaaggtaatgtaattcgaaagaaaaatagctggttttaaggaatgaatggccatgtcaactattggaagcatctttgaactagagcctctatgttcgggtttcaccaggtttatgtttttaattaatatcctattcagcttgctgtaatttccattgaggttttctagaacaagacaagtcagaaattgatctttaattataagctaagagcaaactgccaaagaactgagagaaattttgaagaaacaggtctatcaggactaaccattttaagataataaagactaatcagacacacacacatatgcacaaaaagagggagagagagaacaaaaatcctatgaaatacattttaaaaaatcaatttttttaagaagaagcatttgatctgccaaagagaagagttagtagtttggagatctgacattgctaatctcagggcaagaaaataacaaaataagacaccaaagaattacctaaactgtggaagatgaagctttcagagttctcacagagaaatgggatactaaagtaccaagtttaagaggtgtaatctattaatgtttaatttatgtcccaaatacttaaaaactatgtttcattgttatacatatttattttattataaagataatgaatgcagtagggttagatttaaataattcattgggtttaaaatgagaaatgaaagtctggctttttacaacctacagtcttatcaccaaagttagctattgttaataatttcttgtccattcgtgtatgtgttatggtttctttcttagaaagaagtatgctatactagtatacatactatttattcatgaaccttgcacttatcatgtaatcatatgtcttagtggtcttttcataatagatgtctctctttcccatgctgtcagtggtgactgcatgaggcattgtacagacgtaccaataattacttactctgtgtcatattgatggttattcagattgttttcactttgcccttgcagacaacactgcaatgaacatccttatgcatatattattccaaatacatcatcgtgatggctgtgtgagagaaatacacattgttgattttcttttttattttttataatttcagcttttgattttagatacagtgggtacatgtgcaggtttgttacatgggtatgttgtatgttgtataatgctgaggtttgctgcatgattgatctgatcactcaggtactaggcatagtagttttttttcaacctttaccccctccctccttctaccctcgagtagtccccagtttctattgttcccatctttgtgtccacgtgtactcaatgtttagctcctgcttataagtgagaatatgtggtatttggttttctattcctgtgttaattcgcttagcataacggcatcgagttgcatccatgttgctgtaaaggacatgattttattcttttttatggctgcaaagtattccatgacatatatgtaccatattttctttatccaatccacagctgatgggcacctaggttgattccatgtcttagcgattgtgaattacactgctgattttaatagaaaccactaatttttatgccaacaaaatcatcaatgtgcacatgctccaaggctgtgtgagcatagccctttttcttgagatgtcaacaacactgggttttatcaaaatataatttttgccaatttattagttaacaaatgctaactcagtgctatttggatttgaactaccactggtgctgagcaactttttacatattcactggcaatttatttatctttctctgttgtttatctttttctgtgtaataattttccctatcttctactcttttaaacattaagttttcactgttttcttaataatttttaagtttaaaaagtgaccttttggctggacgcagtggctcacgcctgtaatcccaacactttgggaggccaaggcgggtggatcacaaggtcaggagatcaagaccatcctgcccaacatggtgaaaccctgtctctgctaaaaatacaaaaattggctggggtggtggcacgtgcctgtaatcccagctactcgggaggctgaggcagaagaatcacttgaaccagggagttggaggttgtaatgagccaagatcacgccactgtgctccagcctggcgacagagcgagactctgtctcaaaaaaaaaagtgaccattttatctgctgcatataattctaatgatatttctcaattcgtttatcttttaacaatgataatatataatgtcttgctatttagaaagatttttaaaagtattttatataaacaaatttttattctttgccattaatacttgcaggtttggaattttcaggacctcctcaaaggccacctacaggaaatgctcttcaaagacatttcactttttccccacttgattatggagcaaagactaacactggcaatgctttgaagtacttgagtcaaatgggtctctcatgtggtcattactatactcactctcaggctccagtgcaaattgtttccttacgccaactactcttgctttcttttaatagacctattcctcctgggctgtctgaaactaacatttcattgtaaataaagtcctgcaaatccttggtatctcaaagaaccctccttccatttagttttaggagaactttcctcctaaaactctattcttctccctggagtccagatccccattccttgcaacaaatgaactcttgatttgagcactgaagggagataattggaagtttgactttgtgttctaggttttccctgccaatatatgcagcgtctttaaaactaattgggctgcggcaggagaactgcttgaacccaggaggaggaggttgcagtgagccgaaattgcaccattgaactccagcctgggcgatagagcaaggatccatctcaaaaaaaaaaaaaaaaaaaaaaaaaaaaccagcaaaaagaaactaattaggttcaagaagttcgaatgaattcaactaagacaagctcttaagcagacatgttggaagttccagaaaagacagtttgggaaaatatttttattaaaaaaaaaaaaaaaaaagactgtcctccacttcctcactctttcttcccacttattttcactccactggtgcagtttggtgtcaactctcctcactctactgaaactgctgcagccgaggttactagttatttaattaacaaaagcaatagattttggttttttaattgcattatactctactattttgtgacatttaaactattgacaatgtctttcttgaaaatgtgtcctttttgtttttttcaaaacacgactttctccttgatgtcctcctttttctctcattatttcacctttacattctctgctgacacctttcaccttaccaaaccttaattaaatgtgtatgcttcccagtctcccattcttggctctcttcccttccctcttattgatcattattgtattctgtgatctcaccaattctcttggctttaacaataaccagatgactccagaaaactattcaaaattccggacctatggagactttgcacccagatacgtaccaacaactcaacctcagttatctctaatattatctcattaagtgccctctaactacagaatgactcctccttctgggtttcctctgcctgaatggcaccaccattcagtggcccacgacaaatgtggacctcatttggaacttctccctttccctcatgtttcattttctcttggctaaagagttattagattcttcatttttagcttttctctagcctatcttcaattttatagtggacagttatgtataccctatatcccaggagagaagggatatcttcttctatgcccctactatgaactagcatatcctttgagtcctttctttgtatgaagcactggggaaatttaatcaacttcataatcacttataattctcacagtaattttatgagataagttctatttattatccctctcttaaggatgaggaaactgtggtttaaagagcttaagtaatttgggcaaatcataaaagaagcagtgaagacagaattcaaatctaggcaacctgaaatctgagcctgagcactttgcctccctaataactatctccctttgagagttgtattacaaagttgacaacatttagcaacccttattcccctccccacccctatctctctccaagaaatctgctgtgaggtagagaatgtgttgattttctctgcagattttagtgcatagcatagggcttagaaaggagaaaatgatgaaaaatatttattaaaataattgtttttctttgatagttgttataaccatctaattgtgagtgcttaacaattactataaaggagaatggaaatcactgatcttttcacagaatttttttttttttttttgagacagagtccagcttgtcacccaggctggagtgcagtggtgcgatctcagctcactgcaacctccacctcctgggtttaatcacttgccttggcctcctgagtagctgagattacaggcgtgcaccaccatgcctggctaatttttgtatttttggtagagatggggtttcaccacattggccaggctggtctcaaactcctgacctccagtgatccacccatctcagactcccaaagagctgggattataggcttgaaccaccatgctgggcctttctcagagaatttacagtttacctggaaatgtaaactatatatacttaaactgagggatatttacaaaagagctttctacttaacccacaagaagctgtattaataacaaagcaaatcaagcttgttcacaggcaactgaatggaatgaatggttttgattggtcttgccagttatatttctaacaagagaaaattcaatgtgagcctcatttggaaacaagatattacagaaaggaaaatttgggattaaggtcagatttggtgcaactatgctagatacagaaaaggcaaactttcagctcaatccccagctaagtacaagttcaatggtgaaggcataagaaaatgagccattataataagtctgaaataagtttatgattccacctcaatatgggcatgcaatatattctaatatttaatccctggaaaaaatgatgacatcacactgaaatcttgactcataagagaacttttttatgctgttccctaagtcagtttatttctacttcattcttgtgttaagggcaggctcaattcttactcattcaaaaacagtatcacctgaagcttttctttaattcttgttttctctgcagtgacaaaattaatcaaggggttaaaatgtatattaaattatatatgtattatatataaaagttatatagtatagatcagagaagaatatattgcatatgttataggctgaattgtggcctttccccaaattaatatgctgtaccctgccccctgccccctgccatcccagtatatcagaaggtggctatatttggagatagagacttttaagaggtaactaatgtaaaatgaggtcatatgtctgggtcctaatccaatatcactggtgtccttatttgaagaggaaatttaggtacagacaaacatgtgcacagaaaaaagtccatgagaagacaagatgagaaaatgactatctaaaaggcaaggagagaaatttcagaataaaattaacacatctgatgccttgacctcacacttctagcctccagaactgtgagaaaataaatttctcttgtttaactcatccagtctgcagtaattgttataacaaccctagcaaagtaatataggaagtatatatatatacacatatatatatacacacatacatatatatatacacatatttgtgtgtgtgtgtgtgtgtatatatatatatgatagagtagatagatagagacatatacagtcatccctcagtattagtggggtattggattcaggagccctgcatataccgaagtctgcacatactcaggtcctacagtcaaccttgcagagctcgcatatgaaaagttggccctccacatatgtgggtttcacttcccacaaatactgtattttcaatctgtatttggctgaaaaaatccacctataagtggactcacacagtttaaaccagtgttattcaaaggtcaactgttgatatatagatatataaatatctcatatgtatagagcaagcaggagaaaaaatctctaatctctcttccttcctgctctttttggattgcaaactcttctctcataagtacaaaaagtaatgttaacaaaggaaagagaattggaaatagtagtgtttttgaccactagtgttttgtaattttagaaaaaaaaattactgaaatgtaactttttatttatattgagatgttttgactcatactccaatcatacagaaataatagataaaatatgaaaaagacttctttttacatacatagctggattaaaatatcagagataattttcttccctcaaaggatcccctatttaataaatggtgctgggaaaactggctagccatatgtagaaagctgaaactggatcccttccttacaccatacacaaaaatcaactcaagatggattaaagacttaaatgtaagacctaacaccataaaaaaccctagaagaaaacctaggcaataccattcaagacataggcatgggcaaagacttcatgactagaacaccaaaagcaatggcaacaaaagctaaaatagacaaatgcgatctaattaaactaaagagcttctgcacagcaaaagaaactctcatcagagtgaacaggcaatctaaaaaataggagaaaagttttgcaatatacccgtctaacaaagggctaatatccagaatctacagagaacttcaacaaatttacaagaaaaaaacaaccccatcaaaaagtgggcaaataatatgaacagacacttctcaaaagaagacatttatgcagccaacagacacataaaaaatgctcatcatcgctggtcatcagagaaatacaaatcaaaaccacaatgagataccatcgcatgccagttagaatgatgatcattaaaaagtcaggaaacaacagatactggagaggacgtggagaaataggaatgcttttacactgctggtgggagcgtaaattagttcaaccattgtggaaagcagtgtggtgattcctcaaggatctagaactagaaataccatttgacccagcgatcccattacagggtatatacccgaaggattataaatcatgctactataaagatgtatacatgcacacatatgttaattgtggtgctattcacaatagcaaagaattggaaccaacccaaatgtccatcaatgatagactggattaaaaaaatgtggcacatatgtgccatggaatactatgaagccataaaaaaggataagttcacttcctttgcaaggacatggatgaagctggaaaccatcattctcagcaaactatcacaaggacagaaaaccaaacactgcatgttctcactcacagatgggagttgaacaatgagaatgcatggacacagagtggggaacatcacacactggggcttgtcagggggtggggggctgggggacagatagcattaggagaaatacctaatgtaaatgacaagttgatgggtacagcaaaccaacatggcacatgtatacctatgtaacaaacctgcatgtggtgcacacgtaacctagaacttaagattaaaaaaaaaatttcttccctcacgaggtacaaagccaagcattacactggggccatgatagtccaggttgctgaaagatttagaactaaagactgaaaattgggatatatattgagagagagagagagagaacaaatggtaacctaaatttaataaaataataatagacaaattagggtaacaggcatatgagtattttttgttctaacaattcttttattttcaaacttatctataatcttacatttatttcccaataaaaaggattttaagtttaaaaaagaaagtttttctgtagtaacattttcacaactagggcctttaagactgaggaaatactccaagctctgagcaaactcagtaagtataaatccatatgtagacataccacagtaaaatgcaagatactaaagactaatacaatattttcaaatcaaccagagatggaaggcagattacctacaaaggaaggacaattactttatcacagacttctcttcatcaacgagaacagacaatacaggaataacatctcccaagttgtgagggagaataacagatgacatgaaattctacaaccaaataaagcataattcaatgggcagcagttaacagaattaagctgtttccagacatctatggagatatttaactcaaagatgtcactgtaaatttgattgttgagatgtagtaatggatacttggtaaggttattgaattagttaaacgatcttcaaagcttaggtcatgtatcttccttaaacacatggtgctttgcatttactaaagaagggcttctgttttctctccaaataaatcattgcgaccttagcaccccaagtgtaaaaacctcttttatttctattcttgatctctagtccctgcttatgtgtatgcataaatgcatgacaccgtgcttctcttttagttatttatttctagagatcatgtctttgaaaatcattatattcccagcaactatttagagtggtactaagctaacttggtttatagtgtcaaccgcatagcagttatttgattggcccattcctttataaaatattttatgcttagatgatgaactctacataaattcagccaggagaatgttttccttggcaatctctgggagattacaaatgttacttttttttttttttttttgagatggagtctcgctctgtctcccaggctggagtccagtggcgcgatcttggctcactgcaagctccacctcctgggttcacgccattctcttgcctcagcctcccgagtagctgggactacaggtgcccgccaccatgcccagctaatttttttgtattttagtagagacagagtttcaccgtgttagccaggatggtctcaatctcctgacctcatgatccgcaagcctcggcctcccaaagtgttgggattacaggcttgagccaccgtgcccggcctacaaatgttactattaactcctccttctgctaagaaataaaccaaaataaaattattcacaaatataactgttttgatcatgctttcagatgatatgtaaggtagcccacagaaggtaaataatattcaggggaaataaattattacttaagagtgggtgctgagaaaaagaaatgtgtgaagtgtgaggtaggaagtatgtgagaaaagctagggcacagttgtgtcttatatttttgttaaaatctgcctgttaagacttcctgattgggtaatgggaatgatacagtaaaatactcttcctcagagtgtctgacaccattgtgataacttactacataaaagtacaagttatattatataaaaagacagaatggcctggctcagtggctcatgcctataatcccagcactttgggaggctgaggcaggtggatcatctgagatcaggagttcgggaccagcctggccaaaaggatgaaaccctgtctctactaaaaatacaaaaaattagccaggcatggtggcaggcacctgtaatcccagctactcaaggggcagaggcaggagaatcgcttcaacctgggagacggaggttgcagtgaactgagatcgtgccactgcactccagcctgggcaacaagagcagaaactccgtcccaaaaaaaaaaaatgactccaagaaactgaggtttctagatgagggttacacaatgtggatctaaaagcaacagggaaaggaaaaggatttgggcctagaatgtggggaaattttagatgctgcagaaagccttctggtgtctttctagaatggctggattttggttaagacaaagaagaagtaacttttcatggagaacagtagcatacaggagtgcggatggtttgatcatttaaggcagggatgtgaggtttgatggaatatgttgataacaaagattctttgcttggccaactttagtcaggcttctaaatcttcagctaggctaaactgtgcacttcctcacaaaatccagcattagcaaagaacactgccaagtttaccaaataacccctcattctcaatatctgatcaggttcttcattcttcaccattctgtaggtgatgtctgatcaccctggccagtcttcagcaagaattcttttagggcagtttagccagaatctcccttactcctgatgtttcctcttagtgattctccattcactgacccctgcattgctcctgggctataaattcccacttccccttgctgtattcagagttaagcccatctctctccccagctccaagactgtgttgcagtggttcctatatctatggcaatggtcctgaataaagtcttctttactgtgcatttgaagtatcactgaataattttttctttaacaattatggtgttgaaacagattcatcactggatcctgggcctctcactcaggaccctaaatgcatgcctttgaagtctttgttgtcatttctgactgattagggatccattggtgaatcagattcctgagccattgctccagacaaaagcccgttgatggctatggacagattttgaatcttaagggatgaatattctctctgaagctggggtagagtcccaggcttcttttgaaaggaatcctctgggcaggaaggtcttcctgtgggcttcttgttctgagtgatctattctctgagtccctagactagaagtctcttccttctggctctctttttctgagtgaggggttattccctgattccctgagctacaaattgttcttcctggctctctataaaaccactctgctctttctcttctctctattggatcctgcttctcccatgggagctctgtcacctgaaacccctcttctcaagtctctgctgactatttctctgtccactcttgccagacccgtttcttttctgctgaacttcaggacccctatcctaccctcctttgagggggctctcaagggactcagaggcccctcaaaaacaagcacctggggctgataataggagaaaaaaagaaactatttggaaactgataaagtaaaaaaaaaaaaaatcttaaaaaacctcctccacaaatattggtaaaaagatttagcctttgttatgtaggtcaactcaacttatccctttctcaccagaaacacaatttggataacaatataaagtggagataaaccagtgagtttgtatttttgtattactctgttttactgcctcatggttaaaaacttttttttttttttttttgagacagagtctcacttcattgctcaggctggagtgcagcggggcaatctcggctcactgcaacctccacctcctgggttcaagtgcttcttgtgcctcagccgggcgccacgatgccccacgcccagctaatttttgtatttttagtagagacggggttatgccatgttggccaggctggtctcgaactcctgacctcaggtgatccacccgcctcagcctcccaaagtgctgggattacaggcatgagccactgcacctggcctggttaaaattttttaaatgaaaagtcataagatctggttacatcagtctatatgtttgtgtatgtgtacatgtgtgtatctatgttattatgttatgtatatgtgatatttttctacctccaacgttattaccaaactaaaatacccaaattggctagggataaatgagcactcaaacaaataagaatgtataaaattttcagaaaagtagaaactgacccaattttttttaggttcacataatctgggatattccttagtaaataaaaactagtttaaaaaatattggtaaaataaaaatagaaacattttcagaactgtcagcatacacttattttacctggctttgctgattagacaagtttgtgttgttactgttagatgtttaaggccataaaaccataaattcaacctaagaataggatatgtagtaaaagtaaattgcttaattgtctggtgtatgtctgttgcaaatgtaaataagaaaacatatctagaaggattgtgaaaatcttatcttgtatggtctaagctgactgagattggatagatttatttataaggttttattaaaacttagttttagtaatacattgattcaaaagtagaatttgatcttctccgttaaaatggtaaagttttcttggaatgttggtctgagaatgtaaagggtatttttttccttttaagtaattggcctcagaaacagagactgtttcatcaagataatttcttgagtttcatgttgttttattaggttttggttacttaagaaaagtgagtcttctcaatattaaaggagctaagttcttgttcacaactatgtaatctgaatttgcctttaaaatcttttaatggagcttttattaaatagataactatggtcatatttgttttaaatgttttaaactttttgacatttttgacaatcttcccaaaatcacattctaagttaagtctttttgacctcaaattaacttaggattctccatattggaccctcagaaagccacaaagaatatttttttttgtatgaaagagagattaaaccaattagatttatttaatgtgctaaattatatgtgtagcattcaaataaaaagtgatgctaagccatctttaagttatatttatggatatattattgggataagtgtacaaaagttgtatgagattcctagaaatctagtatgttaacagtcataattttggttattatgttaaaatgctgtatgccatgctaaccaaattttcttataaattgcatcattgtaatgaactctcattagattttttaaccatggacattttaagtccttgtcatctgtagacagtcattgttttaatttacttgttctctaaaagcatttgaaattagctacagtccaaaatggcttcttcttcaaggagatttatggaaaatactcttatgagtattctggaatacaggtttctgaacaactttaacatcatacaattggactggtaagaatttccagaactctaataaaactgacgggttcatgtaactactaacccaagatcaagcaaaacaagatttaattacgtggtactgaatgaaatgatgagaataatttttaaaatgactttttgttggaaacattgctagttctttaaatgttttgttttccagatttcagaaaacttttttttaagctatctctagcttacaccaattcagtaaagaatacttttttgcaaaatggaaacatttactttttctccctaacttatccctccagaatttggaaactatttgtgcatattcttatttttatggcaaagtatttatttgcataagtttaataagaatctgttgtctttgtgacaggacaaactggaaacacaggttatatcaccaaggctttgactgaaacatcatgttttcagatatgaccagaaggctttaggggactaaggttggctttatggaaccaataaagtaccatcttggaaaaactggctctagggttcccagacttacaggtaaataaagaatgtcactgtttggcaggtctggaaaccttgggatattttagggacctcaagaagagagaaatttatctgaatctataaatgtaacaggtgcagactaatgacaagttttgggcttgtatcccagcctcaagtggcttttaaaagtttaatctgactggagacagtggctcacgcctgtaatcccagcactttgggaggccaagtcaggtggatgacgaggtcaggagttcaagaccagcctgaccaatatggtgaaagccctgtctctactaaaaatacaaaaaatgagccaggcatagtggcacgcacctataatcccagctactcgggaggctgagcagaagaatcgcttgaacccaggaggcggaggttgcagtgagccaagatcgcaccactgcactccagcctgagtgacagagggagactctgtctaaaaaaacaaaaacaaaaagttatctgagatttcttatctgacaaacgcaacctttaaaagagcctaaatggtcaatcactactcttaactgcacttgtgtacataaccagtacaagtttaatgagattaaacttatttagcaaacaaatcaatctgactttgattatctttgacagaaatgagagtgaatatagagagaaaagttatgtttcgggagaaaactgcagtgcacccaatattagattctagctgttttttttttttttttcctgaggttttattatctgcctgcaatctgcaatagatcctcaatttttctagtttactacaatatttagctacaatactccaaattaatatttcatttttttcctgctattctggcttggaatcactaaaattataaacttttcttttcttgaagtccttcaaactgaaactggatgacttgacataagcttcagaaaaattaccacaacagcttgtgtgtggcccatctttatggcattcaaactgcaaactaatccaatgcctcttctcactccagctgaagatattaaaagcccagcatctagaaatcttattgatcagctgccctctgggctcagaaactgtctttatagttcgttccaactattaatcttttttaattttatttttatagaaactaaacttcccacattaaaggcctgatagctcacactatccaggaaatatcctctgctaccaagtcccaacagatgattcaactggtccttaatgaataaaaggtgatcaaacaagaaaagagacttatactgtttgaaggaaagatgaatgtctcttctttccttaaacaagaagtagtactaacaaagattccttgcttggccaaactttagtcagatgtctatcttccttgcaaaatccaacttttttttttttatgtcgtacaatgtgatgttttgttctttttaaaatttattattattatactttaagttttagggtacatgtgcacattgtgcaggttagttacatatgtatacatgtgccatgctggtgcgctgcacccactaactcgtcatctagcattaggtatatctcccagtgatatccttcccccctccccccaacccacaacagtccccagagtgtgatgttccccttcctgtgtccatgtgttctcattgttcaattcccacctataagtgagaatatgcggtgtttggttttttgttcttgcgatagtttactgagaatgatgatttccagtttcatctatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttgggtacctacccagtaatgggatggctgggtcaaatggtatttctagttctagatagaatgtttcctcttataactcatagtgaatatgactggacaatgaaactattttgtaatttctttcctgaaagataaaggcgttagaacatagaatctttcattgattctacagaatcttaagactccttcagagatggcagtcattcgtaccgtgctgaacatcatgttgtcacggtcagaatcagaactaaattgattaagggtctgaaacagtttggcactcttgggcacttattctgataagaaagctgatgagacagggtaatgaaaagaggctgcaagaaatgaccattcatgcattcagccaacatttaggccaccctcctgtattccaggcactgtacgtggcactgagaatgcaaagcaaaacgagtcatggtctactggcgggagccttctcagcggagaaaagaccaataagaaaagtgtctgctggagacctctcctagggcataaaccaatatagaggtggggcagctacgtcaccctgaggtgtccttaggcagaacagaaagtgagaatcagagcagtgtctcatttctgaacacctggattgtagctttccctggactgactgtcaaaggaggtggttttaaaaagcaagccaaacaggtttccatcctttaggaagaccctggaatgtgccagttgattctgacaatttctcatgaacagaaacacctaggaagggagaactggtgagtcttttcaagaggaggaagtccctcaaaaggggctgtgtttcgcaaacagcgccccaaaagggctgaaatacttcgatctggaggaaaaagactcaggcactgagggaaggggagggtgcacatctggagtaatttcaaggctttttccgtgttatctgaggtggcaacaagtaaagatttgttcgttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgacgcctgcctgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggtcccccacggcggttggtccgggcgggggaaggagaaagtgagactcggtttcatcaccaatccatcgccagaaggggaggaaattggaatccagcagcggcgagcagcagctgggcggtcacatctggaaatggaaagccgacctccccctcctcctccacctcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcaggtgagttcttgcttttccagaacctcggacccagcgcccccttcccagttctctgaccgcgacgtgtgtggctgggggtggggtggagggtttgcacgtccgcattccggggttcatttggcaacagctgctgcaacgaacgcgggagccaaaagcgggagggggcgccagcctcgccccttcccctccccccacccccaagtctggggcagctaccagctttgagggcagaacccgcgtggcccgagcgggggtctaggcgaaggggcagtgcgtggtatttccagccccacgtagtgcccaaagcctgcaagcacgcctcctgggttccagcagcggcggcagagcggggttggttggacccaccaggtttgcgtaatgggctgagcggcggcggccgggaatggagcctgctgcgctgcgctcgtaagctgcgcccggcgccgaggacccccggggggcagcgctcggcccatctccggccccttcggctccatctagtcccctccgactggcaaagagaagggattcctcggattcccaaggcacccagcgcccctgcctggggggtcgcctttcgtccattttgctcccccaggagagagatcggattttgctttcgctgccgcgagccgggctggggctgcttccggcctccccgaccgggaaattcccgccgttgccatggcacccggcacttgctgccgggggcggcctgccgctgcacccagtcgggggcgcgccgcatcccctgggacgctgcgcggagagacctcgccgccctctagccctcccctcccgcccggccaggcctcccctgactccaccaaatggagggcccaagtcctgatcggggttaaaacaaatccactccaggggtagcttttgacaggactttctgtttcagatttcagatactcagactccacctttacttttacctatgttggcggccccagaaggtatttatgggtgtagagttgcttcatttcctgttcacactcttgtgtttcctttgttcttagcgtgttccgtgttcgggtattttggttgcttgtttgattactgtggcttttctttacctacaacccaagcctgacgtccctcggttttaaatagcagggggaggggaatcaatgtttgattcaggtgtttcgaagaccacgccacaggcgatgagcagaactcttcatgttgaaacggttctgctacagtactagattgctctcaggcgatttggggttgatacaggcaagccggtgcaaaactggaatactggatatgaagtgaaatgtataaaagacataaaatgtcacaaaatagtttgatcacaagtgttaattttcctggtgagttggggctgcgtatttccatgttttctgaaggttcacataaacatgcagcctgccaattctctgtatatattttttttcaatgagtggtatttcggttttcacgtttagttgtaagacagaaattggagacttatatgtagctggagtggatgacttctttcttttgggggaagaatgagagatgcacatttcgttagtaaattgtgaacaacttgaaacaaacccaaatccaattgtgaatttaagaagtagagttaaaatgaaaggtagccattcaaatactatgccttgctgccttcacttattaagttaggattttcttccttttagccctttagggatacagtagtttaaaagagcagtagccacatatgaaaggatcagatttagcttagagggaattccttagaccagccctgctgttaagacttgacattcaatattgtttgatcacattccaaaatataccttagctaatggcaacatttgtaaacatataaattgcaaaagaagctttcttgtgtacatacatttttaaaagcttgaaattgatgtgaacttttaaaaacacgtaggatctgtattacattctatatctcaaaacaaatttaattaaagtgaatatcattccagtatatacaatatgcctaagacccagaattggcacactgatttactagttgaaaatataacagtattcaccaaacttcaatgtatactttttggagagaatgaaattacagtatttcttaatttactgtaatgtcatctttgtaattatgaattaacaattcaatgagaggagacttggttgattaaattaatgctggtcctacacattatatctaaaggatcttcgtatatgactactatcttcttggattattttaacagttaaaatatacaaagtggcccattaaaaacagagttgacttttcaccattgctgtttttctggtgagacatgtggaaaggaaggacaggtggacttttcaactaactagctctctgatttttaataagatacctcagttcttttggcctcagtttacttatctgtacaaagggtaagtcatatgcttaatcactaagatctgttagatactgcagttaagattctttatcaacaaattactgaactctagtgttaacatagctagaggtggaaaagggagcaagaccaggtgttgggatgaataattaactaatcgagataacatcagttttcaccataggaacaagtaccatggttgctcttaaagtaagagatgtttcctattttatgtaattttactaagggataatgttttcttttgtcactgatttaaatgtacctggatgtttctcagccatgtggctaagatcgaacacaagtaatacctgggccttttatatctaatctaatgtagaccagcctgttaaaagagaaagacaattggttaaactgctgatgtgttgctttgtcttctcaaaagcttgttctataatacaatatgtaaaaagttgttacagtgtagtaaccgtagataatccctttatgatttgtacctaatgacgaagaccttttattttctgaaaataacatgtttgttttcattaccgacattagaagccaatatttattaatctatttctcatcctgacatttcagtcagactcttaaaataatcttgctgtgttttgatttaatgtgcttatcaacttataatattgaattaatgttaatagtgtcattttaggtgaactagacttcattgaaggaggtgggagccttatggagagagagtatatgattatctctatttgtatttaattaccatttcatctaaccgttcagaacatatttcaagaataattttaattcaagttgtagataaaacttactataccattttcattttgacgctttccgagaatgagatacacggtattttaaagacaaagattgatcttacatgttactattaaaaaaaacacgataattttgttctacatttatacttttaatttttctgtggataataagaaatgccaagagtcgattgtgtccatgctggcaagtggcctaataaattgtccttttatttggtggtcctcagagtggcagttaacatcttgctattctgccttgtggacttgaggtggaaaggttcatggaattatatccttgcttttggatgtgcaaactgaggctcagagagtttaagacacatagtcactttcaccaatcaaatgatgaagctgccatgtaaacgtatttcatcacactcccgagaccttcttctccagtagtgttttcaagctttttgagcatgcagacactaccaatcaaaaaattatgtagagacatacttgagagttacagtttaaagaaaaacaaggtgtaattatttggttattagtaacatttacatatgtttgaaaacttctgctatatatacagtaagattaatttattctaacaatgatcttgataatccccctgattcccagactccttggaatagctccacagctatcagtggttctgccacaggttcagagccttcccagtactgccttcttatttgagaggtgtgctaagagctataaagcagaggcttcaattgtacacaattgggaagtttaggcaaaagtcatttcttccctatattttgtcatgcttatctcctgtctctttctgttttacagattagcaataaactccttaaaacccaaaggtttgggcttctgttcctttcacttgcagtcagacatggagttagtggtagaagaaacagaaggggtaacctgcatggtgacagctactgaggggatggataggaaagcaggctgagtccctggggccagtggttaccaaagccaaggagagagcaaggggagcccagtgggcctggccatggactgctctggaattccgagtgtgaactttcagccaagaaggtagtgtgaaaatattactgtgaggttttaaaagtaca
